United States Patent 10,100,349 (METHODS OF DETERMINING POLYMORPHISMS) - sequence listing, part 2

SEQ ID NO: 6824 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (12)..(12): base is a locked nucleic acid
raaraargaagyacyaar

SEQ ID NO: 6825 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (13)..(13): base is a locked nucleic acid
aaraaraarayagyacya

SEQ ID NO: 6826 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (17)..(17): base is a locked nucleic acid
araaraargyagyacyaa

SEQ ID NO: 6827 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (15)..(15): base is a locked nucleic acid
raaraargaagyacyaar

SEQ ID NO: 6828 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (15)..(15): base is a locked nucleic acid
aaraaraarayagyacya

SEQ ID NO: 6829 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (11)..(11): base is a locked nucleic acid
araaraargyagyacyaa

SEQ ID NO: 6830 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (13)..(13): base is a locked nucleic acid
raaraargaagyacyaar

SEQ ID NO: 6831 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (16)..(16): base is a locked nucleic acid
aaraaraarayagyacya

SEQ ID NO: 6832 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (15)..(15): base is a locked nucleic acid
araaraargyagyacyaa

SEQ ID NO: 6833 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (14)..(14): base is a locked nucleic acid
raaraargaagyacyaar

SEQ ID NO: 6834 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (5)..(5): base is a locked nucleic acid
  modified_base (9)..(9): base is a locked nucleic acid
  modified_base (10)..(10): base is a locked nucleic acid
aaraaraarayagyacya

SEQ ID NO: 6835 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (10)..(10): base is a locked nucleic acid
araaraargyagyacyaa

SEQ ID NO: 6836 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (4)..(4): base is a locked nucleic acid
  modified_base (9)..(9): base is a locked nucleic acid
  modified_base (10)..(10): base is a locked nucleic acid
raaraargaagyacyaar

SEQ ID NO: 6837 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (3)..(3): base is a locked nucleic acid
  modified_base (9)..(9): base is a locked nucleic acid
  modified_base (10)..(10): base is a locked nucleic acid
aaraaraarayagyacya

SEQ ID NO: 6838 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (5)..(5): base is a locked nucleic acid
  modified_base (9)..(9): base is a locked nucleic acid
  modified_base (10)..(10): base is a locked nucleic acid
araaraargyagyacyaa

SEQ ID NO: 6839 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (7)..(7): base is a locked nucleic acid
  modified_base (9)..(9): base is a locked nucleic acid
  modified_base (10)..(10): base is a locked nucleic acid
raaraargaagyacyaar

SEQ ID NO: 6840 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (4)..(4): base is a locked nucleic acid
  modified_base (9)..(9): base is a locked nucleic acid
  modified_base (10)..(10): base is a locked nucleic acid
aaraaraarayagyacya

SEQ ID NO: 6841 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (7)..(7): base is a locked nucleic acid
  modified_base (9)..(9): base is a locked nucleic acid
  modified_base (10)..(10): base is a locked nucleic acid
araaraargyagyacyaa

SEQ ID NO: 6842 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (2)..(2): base is a locked nucleic acid
  modified_base (9)..(9): base is a locked nucleic acid
  modified_base (10)..(10): base is a locked nucleic acid
raaraargaagyacyaar

SEQ ID NO: 6843 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (7)..(7): base is a locked nucleic acid
  modified_base (9)..(9): base is a locked nucleic acid
  modified_base (10)..(10): base is a locked nucleic acid
aaraaraarayagyacya

SEQ ID NO: 6844 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (2)..(2): base is a locked nucleic acid
  modified_base (9)..(9): base is a locked nucleic acid
  modified_base (10)..(10): base is a locked nucleic acid
araaraargyagyacyaa

SEQ ID NO: 6845 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (3)..(3): base is a locked nucleic acid
  modified_base (9)..(9): base is a locked nucleic acid
  modified_base (10)..(10): base is a locked nucleic acid
raaraargaagyacyaar

SEQ ID NO: 6846 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
aaraaraarayagyacya

SEQ ID NO: 6847 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
araaraargyagyacyaa

SEQ ID NO: 6848 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
raaraargaagyacyaar

SEQ ID NO: 6849 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (10)..(10): base is a locked nucleic acid
araaraarayagyacya

SEQ ID NO: 6850 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (12)..(12): base is a locked nucleic acid
raaraargyagyacyaa

SEQ ID NO: 6851 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (17)..(17): base is a locked nucleic acid
aaraargaagyacyaar

SEQ ID NO: 6852 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (15)..(15): base is a locked nucleic acid
araaraarayagyacya

SEQ ID NO: 6853 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (10)..(10): base is a locked nucleic acid
raaraargyagyacyaa

SEQ ID NO: 6854 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (15)..(15): base is a locked nucleic acid
aaraargaagyacyaar

SEQ ID NO: 6855 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (12)..(12): base is a locked nucleic acid
araaraarayagyacya

SEQ ID NO: 6856 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (16)..(16): base is a locked nucleic acid
raaraargyagyacyaa

SEQ ID NO: 6857 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (16)..(16): base is a locked nucleic acid
aaraargaagyacyaar

SEQ ID NO: 6858 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (9)..(9): base is a locked nucleic acid
araaraarayagyacya

SEQ ID NO: 6859 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (15)..(15): base is a locked nucleic acid
raaraargyagyacyaa

SEQ ID NO: 6860 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (11)..(11): base is a locked nucleic acid
aaraargaagyacyaar

SEQ ID NO: 6861 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (3)..(3): base is a locked nucleic acid
araaraarayagyacya

SEQ ID NO: 6862 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (2)..(2): base is a locked nucleic acid
raaraargyagyacyaa

SEQ ID NO: 6863 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (6)..(6): base is a locked nucleic acid
aaraargaagyacyaar

SEQ ID NO: 6864 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (7)..(7): base is a locked nucleic acid
araaraarayagyacya

SEQ ID NO: 6865 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (6)..(6): base is a locked nucleic acid
raaraargyagyacyaa

SEQ ID NO: 6866 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (2)..(2): base is a locked nucleic acid
aaraargaagyacyaar

SEQ ID NO: 6867 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (2)..(2): base is a locked nucleic acid
araaraarayagyacya

SEQ ID NO: 6868 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (7)..(7): base is a locked nucleic acid
raaraargyagyacyaa

SEQ ID NO: 6869 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (1)..(1): base is a locked nucleic acid
aaraargaagyacyaar

SEQ ID NO: 6870 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (6)..(6): base is a locked nucleic acid
araaraarayagyacya

SEQ ID NO: 6871 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (5)..(5): base is a locked nucleic acid
raaraargyagyacyaa

SEQ ID NO: 6872 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (3)..(3): base is a locked nucleic acid
aaraargaagyacyaar

SEQ ID NO: 6873 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (10)..(10): base is a locked nucleic acid
araaraarayagyacya

SEQ ID NO: 6874 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (13)..(13): base is a locked nucleic acid
raaraargyagyacyaa

SEQ ID NO: 6875 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (11)..(11): base is a locked nucleic acid
aaraargaagyacyaar

SEQ ID NO: 6876 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (12)..(12): base is a locked nucleic acid
araaraarayagyacya

SEQ ID NO: 6877 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (16)..(16): base is a locked nucleic acid
raaraargyagyacyaa

SEQ ID NO: 6878 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (14)..(14): base is a locked nucleic acid
aaraargaagyacyaar

SEQ ID NO: 6879 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (14)..(14): base is a locked nucleic acid
araaraarayagyacya

SEQ ID NO: 6880 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (10)..(10): base is a locked nucleic acid
raaraargyagyacyaa

SEQ ID NO: 6881 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (12)..(12): base is a locked nucleic acid
aaraargaagyacyaar

SEQ ID NO: 6882 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (15)..(15): base is a locked nucleic acid
araaraarayagyacya

SEQ ID NO: 6883 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (14)..(14): base is a locked nucleic acid
raaraargyagyacyaa

SEQ ID NO: 6884 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (13)..(13): base is a locked nucleic acid
aaraargaagyacyaar

SEQ ID NO: 6885 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (4)..(4): base is a locked nucleic acid
  modified_base (8)..(8): base is a locked nucleic acid
  modified_base (9)..(9): base is a locked nucleic acid
araaraarayagyacya

SEQ ID NO: 6886 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (7)..(7): base is a locked nucleic acid
  modified_base (8)..(8): base is a locked nucleic acid
  modified_base (9)..(9): base is a locked nucleic acid
raaraargyagyacyaa

SEQ ID NO: 6887 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (3)..(3): base is a locked nucleic acid
  modified_base (8)..(8): base is a locked nucleic acid
  modified_base (9)..(9): base is a locked nucleic acid
aaraargaagyacyaar

SEQ ID NO: 6888 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (2)..(2): base is a locked nucleic acid
  modified_base (8)..(8): base is a locked nucleic acid
  modified_base (9)..(9): base is a locked nucleic acid
araaraarayagyacya

SEQ ID NO: 6889 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (4)..(4): base is a locked nucleic acid
  modified_base (8)..(8): base is a locked nucleic acid
  modified_base (9)..(9): base is a locked nucleic acid
raaraargyagyacyaa

SEQ ID NO: 6890 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
aaraargaagyacyaar

SEQ ID NO: 6891 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (3)..(3): base is a locked nucleic acid
  modified_base (8)..(8): base is a locked nucleic acid
  modified_base (9)..(9): base is a locked nucleic acid
araaraarayagyacya

SEQ ID NO: 6892 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
raaraargyagyacyaa

SEQ ID NO: 6893 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (1)..(1): base is a locked nucleic acid
  modified_base (8)..(8): base is a locked nucleic acid
  modified_base (9)..(9): base is a locked nucleic acid
aaraargaagyacyaar

SEQ ID NO: 6894 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
araaraarayagyacya

SEQ ID NO: 6895 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (1)..(1): base is a locked nucleic acid
  modified_base (8)..(8): base is a locked nucleic acid
  modified_base (9)..(9): base is a locked nucleic acid
raaraargyagyacyaa

SEQ ID NO: 6896 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (2)..(2): base is a locked nucleic acid
  modified_base (8)..(8): base is a locked nucleic acid
  modified_base (9)..(9): base is a locked nucleic acid
aaraargaagyacyaar

SEQ ID NO: 6897 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
araaraarayagyacya

SEQ ID NO: 6898 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
raaraargyagyacyaa

SEQ ID NO: 6899 - DNA, 17 bp, Artificial Sequence
  Oligonucleotide probe
  misc_binding (1)..(17): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
aaraargaagyacyaar

SEQ ID NO: 6900 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (10)..(10): base is a locked nucleic acid
araaraarayagyac

SEQ ID NO: 6901 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (12)..(12): base is a locked nucleic acid
raaraargyagyacy

SEQ ID NO: 6902 - DNA, 16 bp, Artificial Sequence
  Oligonucleotide probe
  misc_binding (1)..(16): Hybridization probe for the specific detection of mutant HIV-1 at codon 67 of the reverse transcriptase gene.
aaraargaagyacyaa

SEQ ID NO: 6903 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (15)..(15): base is a locked nucleic acid
araaraarayagyac

SEQ ID NO: 6904 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (10)..(10): base is a locked nucleic acid
raaraargyagyacy

SEQ ID NO: 6905 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (15)..(15): base is a locked nucleic acid
aaraargaagyacya

SEQ ID NO: 6906 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (12)..(12): base is a locked nucleic acid
araaraarayagyac

SEQ ID NO: 6907 - DNA, 15 bp, Artificial Sequence
  Oligonucleotide probe
  misc_binding (1)..(15): Hybridization probe for the specific detection of mutant HIV-1 at codon 67 of the reverse transcriptase gene.
raaraargyagyacy

SEQ ID NO: 6908 - DNA, 15 bp, Artificial Sequence
  Oligonucleotide probe
  misc_binding (1)..(15): Hybridization probe for the specific detection of mutant HIV-1 at codon 67 of the reverse transcriptase gene.
aaraargaagyacya

SEQ ID NO: 6909 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (9)..(9): base is a locked nucleic acid
araaraarayagyac

SEQ ID NO: 6910 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (15)..(15): base is a locked nucleic acid
raaraargyagyacy

SEQ ID NO: 6911 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (11)..(11): base is a locked nucleic acid
aaraargaagyacya

SEQ ID NO: 6912 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (3)..(3): base is a locked nucleic acid
araaraarayagyac

SEQ ID NO: 6913 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (2)..(2): base is a locked nucleic acid
raaraargyagyacy

SEQ ID NO: 6914 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (6)..(6): base is a locked nucleic acid
aaraargaagyacya

SEQ ID NO: 6915 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (7)..(7): base is a locked nucleic acid
araaraarayagyac

SEQ ID NO: 6916 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (6)..(6): base is a locked nucleic acid
raaraargyagyacy

SEQ ID NO: 6917 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (2)..(2): base is a locked nucleic acid
aaraargaagyacya

SEQ ID NO: 6918 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (2)..(2): base is a locked nucleic acid
araaraarayagyac

SEQ ID NO: 6919 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (7)..(7): base is a locked nucleic acid
raaraargyagyacy

SEQ ID NO: 6920 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (1)..(1): base is a locked nucleic acid
aaraargaagyacya

SEQ ID NO: 6921 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (6)..(6): base is a locked nucleic acid
araaraarayagyac

SEQ ID NO: 6922 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (5)..(5): base is a locked nucleic acid
raaraargyagyacy

SEQ ID NO: 6923 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (3)..(3): base is a locked nucleic acid
aaraargaagyacya

SEQ ID NO: 6924 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (10)..(10): base is a locked nucleic acid
araaraarayagyac

SEQ ID NO: 6925 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (13)..(13): base is a locked nucleic acid
raaraargyagyacy

SEQ ID NO: 6926 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (11)..(11): base is a locked nucleic acid
aaraargaagyacya

SEQ ID NO: 6927 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (12)..(12): base is a locked nucleic acid
araaraarayagyac

SEQ ID NO: 6928 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
raaraargyagyacy

SEQ ID NO: 6929 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (14)..(14): base is a locked nucleic acid
aaraargaagyacya

SEQ ID NO: 6930 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (14)..(14): base is a locked nucleic acid
araaraarayagyac

SEQ ID NO: 6931 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (10)..(10): base is a locked nucleic acid
raaraargyagyacy

SEQ ID NO: 6932 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (12)..(12): base is a locked nucleic acid
aaraargaagyacya

SEQ ID NO: 6933 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (15)..(15): base is a locked nucleic acid
araaraarayagyac

SEQ ID NO: 6934 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (14)..(14): base is a locked nucleic acid
raaraargyagyacy

SEQ ID NO: 6935 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (13)..(13): base is a locked nucleic acid
aaraargaagyacya

SEQ ID NO: 6936 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (4)..(4): base is a locked nucleic acid
  modified_base (8)..(8): base is a locked nucleic acid
  modified_base (9)..(9): base is a locked nucleic acid
araaraarayagyac

SEQ ID NO: 6937 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (7)..(7): base is a locked nucleic acid
  modified_base (8)..(8): base is a locked nucleic acid
  modified_base (9)..(9): base is a locked nucleic acid
raaraargyagyacy

SEQ ID NO: 6938 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (3)..(3): base is a locked nucleic acid
  modified_base (8)..(8): base is a locked nucleic acid
  modified_base (9)..(9): base is a locked nucleic acid
aaraargaagyacya

SEQ ID NO: 6939 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (2)..(2): base is a locked nucleic acid
  modified_base (8)..(8): base is a locked nucleic acid
  modified_base (9)..(9): base is a locked nucleic acid
araaraarayagyac

SEQ ID NO: 6940 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (4)..(4): base is a locked nucleic acid
  modified_base (8)..(8): base is a locked nucleic acid
  modified_base (9)..(9): base is a locked nucleic acid
raaraargyagyacy

SEQ ID NO: 6941 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
aaraargaagyacya

SEQ ID NO: 6942 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (3)..(3): base is a locked nucleic acid
  modified_base (8)..(8): base is a locked nucleic acid
  modified_base (9)..(9): base is a locked nucleic acid
araaraarayagyac

SEQ ID NO: 6943 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
raaraargyagyacy

SEQ ID NO: 6944 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (1)..(1): base is a locked nucleic acid
  modified_base (8)..(8): base is a locked nucleic acid
  modified_base (9)..(9): base is a locked nucleic acid
aaraargaagyacya

SEQ ID NO: 6945 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
araaraarayagyac

SEQ ID NO: 6946 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (1)..(1): base is a locked nucleic acid
  modified_base (8)..(8): base is a locked nucleic acid
  modified_base (9)..(9): base is a locked nucleic acid
raaraargyagyacy

SEQ ID NO: 6947 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (2)..(2): base is a locked nucleic acid
  modified_base (8)..(8): base is a locked nucleic acid
  modified_base (9)..(9): base is a locked nucleic acid
aaraargaagyacya

SEQ ID NO: 6948 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
araaraarayagyac

SEQ ID NO: 6949 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
raaraargyagyacy

SEQ ID NO: 6950 - DNA, 15 bp, Artificial Sequence
  Oligonucleotide probe
  misc_binding (1)..(15): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
aaraargaagyacya

SEQ ID NO: 6951 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (10)..(10): base is a locked nucleic acid
araaraarayagy

SEQ ID NO: 6952 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (12)..(12): base is a locked nucleic acid
raaraargyagya

SEQ ID NO: 6953 - DNA, 14 bp, Artificial Sequence
  Oligonucleotide probe
  misc_binding (1)..(14): Hybridization probe for the specific detection of mutant HIV-1 at codon 67 of the reverse transcriptase gene.
aaraargaagyacy

SEQ ID NO: 6954 - DNA, 14 bp, Artificial Sequence
  Oligonucleotide probe
  misc_binding (1)..(14): Hybridization probe for the specific detection of mutant HIV-1 at codon 67 of the reverse transcriptase gene.
araaraarayagya

SEQ ID NO: 6955 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (10)..(10): base is a locked nucleic acid
raaraargyagya

SEQ ID NO: 6956 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (12)..(12): base is a locked nucleic acid
araaraarayagy

SEQ ID NO: 6957 - DNA, 14 bp, Artificial Sequence
  Oligonucleotide probe
  misc_binding (1)..(14): Hybridization probe for the specific detection of mutant HIV-1 at codon 67 of the reverse transcriptase gene.
raaraargyagyac

SEQ ID NO: 6958 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (9)..(9): base is a locked nucleic acid
araaraarayagy

SEQ ID NO: 6959 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (11)..(11): base is a locked nucleic acid
aaraargaagyac

SEQ ID NO: 6960 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (3)..(3): base is a locked nucleic acid
araaraarayagy

SEQ ID NO: 6961 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (2)..(2): base is a locked nucleic acid
raaraargyagya

SEQ ID NO: 6962 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (6)..(6): base is a locked nucleic acid
aaraargaagyac

SEQ ID NO: 6963 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (7)..(7): base is a locked nucleic acid
araaraarayagy

SEQ ID NO: 6964 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (6)..(6): base is a locked nucleic acid
raaraargyagya

SEQ ID NO: 6965 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (2)..(2): base is a locked nucleic acid
aaraargaagyac

SEQ ID NO: 6966 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (2)..(2): base is a locked nucleic acid
araaraarayagy

SEQ ID NO: 6967 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (7)..(7): base is a locked nucleic acid
raaraargyagya

SEQ ID NO: 6968 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (1)..(1): base is a locked nucleic acid
aaraargaagyac

SEQ ID NO: 6969 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (6)..(6): base is a locked nucleic acid
araaraarayagy

SEQ ID NO: 6970 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (5)..(5): base is a locked nucleic acid
raaraargyagya

SEQ ID NO: 6971 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (3)..(3): base is a locked nucleic acid
aaraargaagyac

SEQ ID NO: 6972 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (10)..(10): base is a locked nucleic acid
araaraarayagy

SEQ ID NO: 6973 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (13)..(13): base is a locked nucleic acid
raaraargyagya

SEQ ID NO: 6974 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (11)..(11): base is a locked nucleic acid
aaraargaagyac

SEQ ID NO: 6975 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (12)..(12): base is a locked nucleic acid
araaraarayagy

SEQ ID NO: 6976 - DNA, 14 bp, Artificial Sequence
  Oligonucleotide probe
  misc_binding (1)..(14): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
raaraargyagyac

SEQ ID NO: 6977 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
aaraargaagyac

SEQ ID NO: 6978 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
araaraarayagy

SEQ ID NO: 6979 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (10)..(10): base is a locked nucleic acid
raaraargyagya

SEQ ID NO: 6980 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (12)..(12): base is a locked nucleic acid
aaraargaagyac

SEQ ID NO: 6981 - DNA, 14 bp, Artificial Sequence
  Oligonucleotide probe
  misc_binding (1)..(14): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
araaraarayagya

SEQ ID NO: 6982 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
raaraargyagya

SEQ ID NO: 6983 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
  modified_base (13)..(13): base is a locked nucleic acid
aaraargaagyac

SEQ ID NO: 6984 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (4)..(4): base is a locked nucleic acid
  modified_base (8)..(8): base is a locked nucleic acid
  modified_base (9)..(9): base is a locked nucleic acid
araaraarayagy

SEQ ID NO: 6985 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (7)..(7): base is a locked nucleic acid
  modified_base (8)..(8): base is a locked nucleic acid
  modified_base (9)..(9): base is a locked nucleic acid
raaraargyagya

SEQ ID NO: 6986 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (3)..(3): base is a locked nucleic acid
  modified_base (8)..(8): base is a locked nucleic acid
  modified_base (9)..(9): base is a locked nucleic acid
aaraargaagyac

SEQ ID NO: 6987 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (2)..(2): base is a locked nucleic acid
  modified_base (8)..(8): base is a locked nucleic acid
  modified_base (9)..(9): base is a locked nucleic acid
araaraarayagy

SEQ ID NO: 6988 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (4)..(4): base is a locked nucleic acid
  modified_base (8)..(8): base is a locked nucleic acid
  modified_base (9)..(9): base is a locked nucleic acid
raaraargyagya

SEQ ID NO: 6989 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
aaraargaagyac

SEQ ID NO: 6990 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (3)..(3): base is a locked nucleic acid
  modified_base (8)..(8): base is a locked nucleic acid
  modified_base (9)..(9): base is a locked nucleic acid
araaraarayagy

SEQ ID NO: 6991 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
raaraargyagya

SEQ ID NO: 6992 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (1)..(1): base is a locked nucleic acid
  modified_base (8)..(8): base is a locked nucleic acid
  modified_base (9)..(9): base is a locked nucleic acid
aaraargaagyac

SEQ ID NO: 6993 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (6)..(6): base is a locked nucleic acid
  modified_base (8)..(8): base is a locked nucleic acid
  modified_base (9)..(9): base is a locked nucleic acid
araaraarayagy

SEQ ID NO: 6994 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (1)..(1): base is a locked nucleic acid
  modified_base (8)..(8): base is a locked nucleic acid
  modified_base (9)..(9): base is a locked nucleic acid
raaraargyagya

SEQ ID NO: 6995 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (2)..(2): base is a locked nucleic acid
  modified_base (8)..(8): base is a locked nucleic acid
  modified_base (9)..(9): base is a locked nucleic acid
aaraargaagyac

SEQ ID NO: 6996 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
araaraarayagy

SEQ ID NO: 6997 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
raaraargyagya

SEQ ID NO: 6998 - DNA, 13 bp, Artificial Sequence
  Oligonucleotide probe
  misc_binding (1)..(13): Hybridization probe for the specific detection of mutant HIV-1 at codon 67 of the reverse transcriptase gene.
  modified_base (8)..(8): base is a locked nucleic acid
  modified_base (9)..(9): base is a locked nucleic acid
aaraargaagyac

SEQ ID NO: 6999 - DNA, 15 bp, Artificial Sequence
  Oligonucleotide probe
  misc_binding (1)..(15): Hybridization probe for the specific detection of mutant HIV-1 at codon 67 of the reverse transcriptase gene.
gaaaaaaaayagtac

SEQ ID NO: 7000 - DNA, 15 bp, Artificial Sequence
  Oligonucleotide probe
  misc_binding (1)..(15): Hybridization probe for the specific detection of mutant HIV-1 at codon 67 of the reverse transcriptase gene.
gaaaaaaggyagtac

SEQ ID NO: 7001 - DNA, 15 bp, Artificial Sequence
  Oligonucleotide probe
  misc_binding (1)..(15): Hybridization probe for the specific detection of mutant HIV-1 at codon 67 of the reverse transcriptase gene.
gaaaaaagaragtac

SEQ ID NO: 7002 - DNA, 18 bp, Artificial Sequence
  Oligonucleotide probe
  misc_binding (1)..(18): Hybridization probe for the specific detection of mutant HIV-1 at codon 67 of the reverse transcriptase gene.
aaraaraarayagyacya

SEQ ID NO: 7003 - DNA, 18 bp, Artificial Sequence
  Oligonucleotide probe
  misc_binding (1)..(18): Hybridization probe for the specific detection of mutant HIV-1 at codon 67 of the reverse transcriptase gene.
araaraargyagyacyaa

SEQ ID NO: 7004 - DNA, 18 bp, Artificial Sequence
  Oligonucleotide probe
  misc_binding (1)..(18): Hybridization probe for the specific detection of mutant HIV-1 at codon 67 of the reverse transcriptase gene.
raaraargaagyacyaar

SEQ ID NO: 7005 - DNA, 17 bp, Artificial Sequence
  Oligonucleotide probe
  misc_binding (1)..(17): Hybridization probe for the specific detection of mutant HIV-1 at codon 67 of the reverse transcriptase gene.
araaraarayagyacya

SEQ ID NO: 7006 - DNA, 17 bp, Artificial Sequence
  Oligonucleotide probe
  misc_binding (1)..(17): Hybridization probe for the specific detection of mutant HIV-1 at codon 67 of the reverse transcriptase gene.
raaraargyagyacyaa

SEQ ID NO: 7007 - DNA, 17 bp, Artificial Sequence
  Oligonucleotide probe
  misc_binding (1)..(17): Hybridization probe for the specific detection of mutant HIV-1 at codon 67 of the reverse transcriptase gene.
aaraargaagyacyaar

SEQ ID NO: 7008 - DNA, 15 bp, Artificial Sequence
  Oligonucleotide probe
  misc_binding (1)..(15): Hybridization probe for the specific detection of mutant HIV-1 at codon 67 of the reverse transcriptase gene.
araaraarayagyac

SEQ ID NO: 7009 - DNA, 15 bp, Artificial Sequence
  Oligonucleotide probe
  misc_binding (1)..(15): Hybridization probe for the specific detection of mutant HIV-1 at codon 67 of the reverse transcriptase gene.
raaraargyagyacy

SEQ ID NO: 7010 - DNA, 15 bp, Artificial Sequence
  Oligonucleotide probe
  misc_binding (1)..(15): Hybridization probe for the specific detection of mutant HIV-1 at codon 67 of the reverse transcriptase gene.
aaraargaagyacya

SEQ ID NO: 7011 - DNA, 13 bp, Artificial Sequence
  Oligonucleotide probe
  misc_binding (1)..(13): Hybridization probe for the specific detection of mutant HIV-1 at codon 67 of the reverse transcriptase gene.
araaraarayagy

SEQ ID NO: 7012 - DNA, 13 bp, Artificial Sequence
  Oligonucleotide probe
  misc_binding (1)..(13): Hybridization probe for the specific detection of mutant HIV-1 at codon 67 of the reverse transcriptase gene.
raaraargyagya

SEQ ID NO: 7013 - DNA, 13 bp, Artificial Sequence
  Oligonucleotide probe
  misc_binding (1)..(13): Hybridization probe for the specific detection of mutant HIV-1 at codon 67 of the reverse transcriptase gene.
aaraargaagyac

SEQ ID NO: 7014 - DNA, 15 bp, Artificial Sequence
  Oligonucleotide probe
  misc_binding (1)..(15): Hybridization probe for the specific detection of mutant HIV-1 at codon 69 of the reverse transcriptase gene.
agtagyagyagyaaa

SEQ ID NO: 7015 - DNA, 15 bp, Artificial Sequence
  Oligonucleotide probe
  misc_binding (1)..(15): Hybridization probe for the specific detection of mutant HIV-1 at codon 69 of the reverse transcriptase gene.
  misc_feature (12)..(12): n is a, c, g, or t
agtagyagygsnaaa

SEQ ID NO: 7016 - DNA, 15 bp, Artificial Sequence
  Oligonucleotide probe
  misc_binding (1)..(15): Hybridization probe for the specific detection of mutant HIV-1 at codon 69 of the reverse transcriptase gene.
ccatttrtcactgtc

SEQ ID NO: 7017 - DNA, 15 bp, Artificial Sequence
  Oligonucleotide probe
  misc_binding (1)..(15): Hybridization probe for the specific detection of mutant HIV-1 at codon 69 of the reverse transcriptase gene.
  misc_feature (7)..(7): n is a, c, g, or t
tctccanttactgtc

SEQ ID NO: 7018 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (12)..(12): base is a locked nucleic acid
gayagyacyartggagra

SEQ ID NO: 7019 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (11)..(11): base is a locked nucleic acid
ayagyacyartggagraa

SEQ ID NO: 7020 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (16)..(16): base is a locked nucleic acid
gayagyacyartggagra

SEQ ID NO: 7021 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (16)..(16): base is a locked nucleic acid
ayagyacyartggagraa

SEQ ID NO: 7022 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (14)..(14): base is a locked nucleic acid
gayagyacyartggagra

SEQ ID NO: 7023 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (13)..(13): base is a locked nucleic acid
ayagyacyartggagraa

SEQ ID NO: 7024 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (10)..(10): base is a locked nucleic acid
gayagyacyartggagra

SEQ ID NO: 7025 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (10)..(10): base is a locked nucleic acid
ayagyacyartggagraa

SEQ ID NO: 7026 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (8)..(8): base is a locked nucleic acid
gayagyacyartggagra

SEQ ID NO: 7027 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (4)..(4): base is a locked nucleic acid
ayagyacyartggagraa

SEQ ID NO: 7028 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (7)..(7): base is a locked nucleic acid
gayagyacyartggagra

SEQ ID NO: 7029 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (8)..(8): base is a locked nucleic acid
ayagyacyartggagraa

SEQ ID NO: 7030 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
gayagyacyartggagra

SEQ ID NO: 7031 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (3)..(3): base is a locked nucleic acid
ayagyacyartggagraa

SEQ ID NO: 7032 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (6)..(6): base is a locked nucleic acid
gayagyacyartggagra

SEQ ID NO: 7033 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (7)..(7): base is a locked nucleic acid
ayagyacyartggagraa

SEQ ID NO: 7034 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (11)..(11): base is a locked nucleic acid
gayagyacyartggagra

SEQ ID NO: 7035 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (11)..(11): base is a locked nucleic acid
ayagyacyartggagraa

SEQ ID NO: 7036 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (12)..(12): base is a locked nucleic acid
gayagyacyartggagra

SEQ ID NO: 7037 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (13)..(13): base is a locked nucleic acid
ayagyacyartggagraa

SEQ ID NO: 7038 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (18)..(18): base is a locked nucleic acid
gayagyacyartggagra

SEQ ID NO: 7039 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (15)..(15): base is a locked nucleic acid
ayagyacyartggagraa

SEQ ID NO: 7040 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (13)..(13): base is a locked nucleic acid
gayagyacyartggagra

SEQ ID NO: 7041 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
  modified_base (16)..(16): base is a locked nucleic acid
ayagyacyartggagraa

SEQ ID NO: 7042 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (3)..(3): base is a locked nucleic acid
  modified_base (9)..(9): base is a locked nucleic acid
  modified_base (10)..(10): base is a locked nucleic acid
gayagyacyartggagra

SEQ ID NO: 7043 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (5)..(5): base is a locked nucleic acid
  modified_base (9)..(9): base is a locked nucleic acid
  modified_base (10)..(10): base is a locked nucleic acid
ayagyacyartggagraa

SEQ ID NO: 7044 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (4)..(4): base is a locked nucleic acid
  modified_base (9)..(9): base is a locked nucleic acid
  modified_base (10)..(10): base is a locked nucleic acid
gayagyacyartggagra

SEQ ID NO: 7045 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (3)..(3): base is a locked nucleic acid
  modified_base (9)..(9): base is a locked nucleic acid
  modified_base (10)..(10): base is a locked nucleic acid
ayagyacyartggagraa

SEQ ID NO: 7046 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (5)..(5): base is a locked nucleic acid
  modified_base (9)..(9): base is a locked nucleic acid
  modified_base (10)..(10): base is a locked nucleic acid
gayagyacyartggagra

SEQ ID NO: 7047 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (4)..(4): base is a locked nucleic acid
  modified_base (9)..(9): base is a locked nucleic acid
  modified_base (10)..(10): base is a locked nucleic acid
ayagyacyartggagraa

SEQ ID NO: 7048 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (6)..(6): base is a locked nucleic acid
  modified_base (9)..(9): base is a locked nucleic acid
  modified_base (10)..(10): base is a locked nucleic acid
gayagyacyartggagra

SEQ ID NO: 7049 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (7)..(7): base is a locked nucleic acid
  modified_base (9)..(9): base is a locked nucleic acid
  modified_base (10)..(10): base is a locked nucleic acid
ayagyacyartggagraa

SEQ ID NO: 7050 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
gayagyacyartggagra

SEQ ID NO: 7051 - DNA, 18 bp, Artificial Sequence
  Oligonucleotide probe
  misc_binding (1)..(18): Hybridization probe for the specific detection of mutant HIV-1 at codon 70 of the reverse transcriptase gene.
  modified_base (9)..(9): base is a locked nucleic acid
  modified_base (10)..(10): base is a locked nucleic acid
ayagyacyartggagraa

SEQ ID NO: 7052 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (11)..(11): base is a locked nucleic acid
ayagyacyartggagra

SEQ ID NO: 7053 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (10)..(10): base is a locked nucleic acid
yagyacyartggagraa

SEQ ID NO: 7054 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (15)..(15): base is a locked nucleic acid
ayagyacyartggagra

SEQ ID NO: 7055 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (15)..(15): base is a locked nucleic acid
yagyacyartggagraa

SEQ ID NO: 7056 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (13)..(13): base is a locked nucleic acid
ayagyacyartggagra

SEQ ID NO: 7057 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (12)..(12): base is a locked nucleic acid
yagyacyartggagraa

SEQ ID NO: 7058 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (9)..(9): base is a locked nucleic acid
ayagyacyartggagra

SEQ ID NO: 7059 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (9)..(9): base is a locked nucleic acid
yagyacyartggagraa

SEQ ID NO: 7060 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (7)..(7): base is a locked nucleic acid
ayagyacyartggagra

SEQ ID NO: 7061 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (3)..(3): base is a locked nucleic acid
yagyacyartggagraa

SEQ ID NO: 7062 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (6)..(6): base is a locked nucleic acid
ayagyacyartggagra

SEQ ID NO: 7063 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (7)..(7): base is a locked nucleic acid
yagyacyartggagraa

SEQ ID NO: 7064 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
ayagyacyartggagra

SEQ ID NO: 7065 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (2)..(2): base is a locked nucleic acid
yagyacyartggagraa

SEQ ID NO: 7066 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (5)..(5): base is a locked nucleic acid
ayagyacyartggagra

SEQ ID NO: 7067 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (6)..(6): base is a locked nucleic acid
yagyacyartggagraa

SEQ ID NO: 7068 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (10)..(10): base is a locked nucleic acid
ayagyacyartggagra

SEQ ID NO: 7069 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (10)..(10): base is a locked nucleic acid
yagyacyartggagraa

SEQ ID NO: 7070 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (11)..(11): base is a locked nucleic acid
ayagyacyartggagra

SEQ ID NO: 7071 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (12)..(12): base is a locked nucleic acid
yagyacyartggagraa

SEQ ID NO: 7072 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (17)..(17): base is a locked nucleic acid
ayagyacyartggagra

SEQ ID NO: 7073 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (14)..(14): base is a locked nucleic acid
yagyacyartggagraa

SEQ ID NO: 7074 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (12)..(12): base is a locked nucleic acid
ayagyacyartggagra

SEQ ID NO: 7075 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (15)..(15): base is a locked nucleic acid
yagyacyartggagraa

SEQ ID NO: 7076 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (2)..(2): base is a locked nucleic acid
  modified_base (8)..(8): base is a locked nucleic acid
  modified_base (9)..(9): base is a locked nucleic acid
ayagyacyartggagra

SEQ ID NO: 7077 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (4)..(4): base is a locked nucleic acid
  modified_base (8)..(8): base is a locked nucleic acid
  modified_base (9)..(9): base is a locked nucleic acid
yagyacyartggagraa

SEQ ID NO: 7078 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (3)..(3): base is a locked nucleic acid
  modified_base (8)..(8): base is a locked nucleic acid
  modified_base (9)..(9): base is a locked nucleic acid
ayagyacyartggagra

SEQ ID NO: 7079 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (2)..(2): base is a locked nucleic acid
  modified_base (8)..(8): base is a locked nucleic acid
  modified_base (9)..(9): base is a locked nucleic acid
yagyacyartggagraa

SEQ ID NO: 7080 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (4)..(4): base is a locked nucleic acid
  modified_base (8)..(8): base is a locked nucleic acid
  modified_base (9)..(9): base is a locked nucleic acid
ayagyacyartggagra

SEQ ID NO: 7081 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (3)..(3): base is a locked nucleic acid
  modified_base (8)..(8): base is a locked nucleic acid
  modified_base (9)..(9): base is a locked nucleic acid
yagyacyartggagraa

SEQ ID NO: 7082 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (5)..(5): base is a locked nucleic acid
  modified_base (8)..(8): base is a locked nucleic acid
  modified_base (9)..(9): base is a locked nucleic acid
ayagyacyartggagra

SEQ ID NO: 7083 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (6)..(6): base is a locked nucleic acid
  modified_base (8)..(8): base is a locked nucleic acid
  modified_base (9)..(9): base is a locked nucleic acid
yagyacyartggagraa

SEQ ID NO: 7084 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
ayagyacyartggagra

SEQ ID NO: 7085 - DNA, 17 bp, Artificial Sequence
  Oligonucleotide probe
  misc_binding (1)..(17): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
yagyacyartggagraa

SEQ ID NO: 7086 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (11)..(11): base is a locked nucleic acid
ayagyacyartggag

SEQ ID NO: 7087 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (10)..(10): base is a locked nucleic acid
yagyacyartggagr

SEQ ID NO: 7088 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (15)..(15): base is a locked nucleic acid
ayagyacyartggag

SEQ ID NO: 7089 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (15)..(15): base is a locked nucleic acid
yagyacyartggagr

SEQ ID NO: 7090 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (13)..(13): base is a locked nucleic acid
ayagyacyartggag

SEQ ID NO: 7091 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (12)..(12): base is a locked nucleic acid
yagyacyartggagr

SEQ ID NO: 7092 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (9)..(9): base is a locked nucleic acid
ayagyacyartggag

SEQ ID NO: 7093 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (9)..(9): base is a locked nucleic acid
yagyacyartggagr

SEQ ID NO: 7094 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (7)..(7): base is a locked nucleic acid
ayagyacyartggag

SEQ ID NO: 7095 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (3)..(3): base is a locked nucleic acid
yagyacyartggagr

SEQ ID NO: 7096 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (6)..(6): base is a locked nucleic acid
ayagyacyartggag

SEQ ID NO: 7097 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (7)..(7): base is a locked nucleic acid
yagyacyartggagr

SEQ ID NO: 7098 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
ayagyacyartggag

SEQ ID NO: 7099 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (2)..(2): base is a locked nucleic acid
yagyacyartggagr

SEQ ID NO: 7100 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (5)..(5): base is a locked nucleic acid
ayagyacyartggag

SEQ ID NO: 7101 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (6)..(6): base is a locked nucleic acid
yagyacyartggagr

SEQ ID NO: 7102 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (10)..(10): base is a locked nucleic acid
ayagyacyartggag

SEQ ID NO: 7103 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (10)..(10): base is a locked nucleic acid
yagyacyartggagr

SEQ ID NO: 7104 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (11)..(11): base is a locked nucleic acid
ayagyacyartggag

SEQ ID NO: 7105 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (12)..(12): base is a locked nucleic acid
yagyacyartggagr

SEQ ID NO: 7106 - DNA, 16 bp, Artificial Sequence
  Oligonucleotide probe
  misc_binding (1)..(16): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
ayagyacyartggagr

SEQ ID NO: 7107 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (14)..(14): base is a locked nucleic acid
yagyacyartggagr

SEQ ID NO: 7108 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (12)..(12): base is a locked nucleic acid
ayagyacyartggag

SEQ ID NO: 7109 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (15)..(15): base is a locked nucleic acid
yagyacyartggagr

SEQ ID NO: 7110 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (2)..(2): base is a locked nucleic acid
  modified_base (8)..(8): base is a locked nucleic acid
  modified_base (9)..(9): base is a locked nucleic acid
ayagyacyartggag

SEQ ID NO: 7111 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (4)..(4): base is a locked nucleic acid
  modified_base (8)..(8): base is a locked nucleic acid
  modified_base (9)..(9): base is a locked nucleic acid
yagyacyartggagr

SEQ ID NO: 7112 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (3)..(3): base is a locked nucleic acid
  modified_base (8)..(8): base is a locked nucleic acid
  modified_base (9)..(9): base is a locked nucleic acid
ayagyacyartggag

SEQ ID NO: 7113 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (2)..(2): base is a locked nucleic acid
  modified_base (8)..(8): base is a locked nucleic acid
  modified_base (9)..(9): base is a locked nucleic acid
yagyacyartggagr

SEQ ID NO: 7114 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (4)..(4): base is a locked nucleic acid
  modified_base (8)..(8): base is a locked nucleic acid
  modified_base (9)..(9): base is a locked nucleic acid
ayagyacyartggag

SEQ ID NO: 7115 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (3)..(3): base is a locked nucleic acid
  modified_base (8)..(8): base is a locked nucleic acid
  modified_base (9)..(9): base is a locked nucleic acid
yagyacyartggagr

SEQ ID NO: 7116 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (5)..(5): base is a locked nucleic acid
  modified_base (8)..(8): base is a locked nucleic acid
  modified_base (9)..(9): base is a locked nucleic acid
ayagyacyartggag

SEQ ID NO: 7117 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (6)..(6): base is a locked nucleic acid
  modified_base (8)..(8): base is a locked nucleic acid
  modified_base (9)..(9): base is a locked nucleic acid
yagyacyartggagr

SEQ ID NO: 7118 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
ayagyacyartggag

SEQ ID NO: 7119 - DNA, 15 bp, Artificial Sequence
  Oligonucleotide probe
  misc_binding (1)..(15): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
yagyacyartggagr

SEQ ID NO: 7120 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (11)..(11): base is a locked nucleic acid
ayagyacyartgg

SEQ ID NO: 7121 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (10)..(10): base is a locked nucleic acid
yagyacyartgga

SEQ ID NO: 7122 - DNA, 14 bp, Artificial Sequence
  Oligonucleotide probe
  misc_binding (1)..(14): Hybridization probe for the specific detection of mutant HIV-1 at codon 70 of the reverse transcriptase gene.
ayagyacyartgga

SEQ ID NO: 7123 - DNA, 14 bp, Artificial Sequence
  Oligonucleotide probe
  misc_binding (1)..(14): Hybridization probe for the specific detection of mutant HIV-1 at codon 70 of the reverse transcriptase gene.
yagyacyartggag

SEQ ID NO: 7124 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (13)..(13): base is a locked nucleic acid
ayagyacyartgg

SEQ ID NO: 7125 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (12)..(12): base is a locked nucleic acid
yagyacyartgga

SEQ ID NO: 7126 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (9)..(9): base is a locked nucleic acid
ayagyacyartgg

SEQ ID NO: 7127 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (9)..(9): base is a locked nucleic acid
yagyacyartgga

SEQ ID NO: 7128 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (7)..(7): base is a locked nucleic acid
ayagyacyartgg

SEQ ID NO: 7129 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (3)..(3): base is a locked nucleic acid
yagyacyartgga

SEQ ID NO: 7130 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (6)..(6): base is a locked nucleic acid
ayagyacyartgg

SEQ ID NO: 7131 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (7)..(7): base is a locked nucleic acid
yagyacyartgga

SEQ ID NO: 7132 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
ayagyacyartgg

SEQ ID NO: 7133 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (2)..(2): base is a locked nucleic acid
yagyacyartgga

SEQ ID NO: 7134 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (5)..(5): base is a locked nucleic acid
ayagyacyartgg

SEQ ID NO: 7135 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (6)..(6): base is a locked nucleic acid
yagyacyartgga

SEQ ID NO: 7136 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (10)..(10): base is a locked nucleic acid
ayagyacyartgg

SEQ ID NO: 7137 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (10)..(10): base is a locked nucleic acid
yagyacyartgga

SEQ ID NO: 7138 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (11)..(11): base is a locked nucleic acid
ayagyacyartgg

SEQ ID NO: 7139 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (12)..(12): base is a locked nucleic acid
yagyacyartgga

SEQ ID NO: 7140 - DNA, 14 bp, Artificial Sequence
  Oligonucleotide probe
  misc_binding (1)..(14): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
ayagyacyartgga

SEQ ID NO: 7141 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
yagyacyartgga

SEQ ID NO: 7142 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
  modified_base (12)..(12): base is a locked nucleic acid
ayagyacyartgg

SEQ ID NO: 7143 - DNA, 14 bp, Artificial Sequence
  Oligonucleotide probe
  misc_binding (1)..(14): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
yagyacyartggag

SEQ ID NO: 7144 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (2)..(2): base is a locked nucleic acid
  modified_base (8)..(8): base is a locked nucleic acid
  modified_base (9)..(9): base is a locked nucleic acid
ayagyacyartgg

SEQ ID NO: 7145 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (4)..(4): base is a locked nucleic acid
  modified_base (8)..(8): base is a locked nucleic acid
  modified_base (9)..(9): base is a locked nucleic acid
yagyacyartgga

SEQ ID NO: 7146 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (3)..(3): base is a locked nucleic acid
  modified_base (8)..(8): base is a locked nucleic acid
  modified_base (9)..(9): base is a locked nucleic acid
ayagyacyartgg

SEQ ID NO: 7147 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (2)..(2): base is a locked nucleic acid
  modified_base (8)..(8): base is a locked nucleic acid
  modified_base (9)..(9): base is a locked nucleic acid
yagyacyartgga

SEQ ID NO: 7148 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (4)..(4): base is a locked nucleic acid
  modified_base (8)..(8): base is a locked nucleic acid
  modified_base (9)..(9): base is a locked nucleic acid
ayagyacyartgg

SEQ ID NO: 7149 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (3)..(3): base is a locked nucleic acid
  modified_base (8)..(8): base is a locked nucleic acid
  modified_base (9)..(9): base is a locked nucleic acid
yagyacyartgga

SEQ ID NO: 7150 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (5)..(5): base is a locked nucleic acid
  modified_base (8)..(8): base is a locked nucleic acid
  modified_base (9)..(9): base is a locked nucleic acid
ayagyacyartgg

SEQ ID NO: 7151 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (6)..(6): base is a locked nucleic acid
  modified_base (8)..(8): base is a locked nucleic acid
  modified_base (9)..(9): base is a locked nucleic acid
yagyacyartgga

SEQ ID NO: 7152 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
ayagyacyartgg

SEQ ID NO: 7153 - DNA, 13 bp, Artificial Sequence
  Oligonucleotide probe
  misc_binding (1)..(13): Hybridization probe for the specific detection of mutant HIV-1 at codon 70 of the reverse transcriptase gene.
  modified_base (8)..(8): base is a locked nucleic acid
  modified_base (9)..(9): base is a locked nucleic acid
yagyacyartgga

SEQ ID NO: 7154 - DNA, 15 bp, Artificial Sequence
  Oligonucleotide probe
  misc_binding (1)..(15): Hybridization probe for the specific detection of mutant HIV-1 at codon 70 of the reverse transcriptase gene.
cagtactgartggag

SEQ ID NO: 7155 - DNA, 15 bp, Artificial Sequence
  Oligonucleotide probe
  misc_binding (1)..(15): Hybridization probe for the specific detection of mutant HIV-1 at codon 70 of the reverse transcriptase gene.
cagtactggrtggag

SEQ ID NO: 7156 - DNA, 15 bp, Artificial Sequence
  Oligonucleotide probe
  misc_binding (1)..(15): Hybridization probe for the specific detection of mutant HIV-1 at codon 70 of the reverse transcriptase gene.
cagtactcartggag

SEQ ID NO: 7157 - DNA, 18 bp, Artificial Sequence
  Oligonucleotide probe
  misc_binding (1)..(18): Hybridization probe for the specific detection of mutant HIV-1 at codon 70 of the reverse transcriptase gene.
gayagyacyartggagra

SEQ ID NO: 7158 - DNA, 18 bp, Artificial Sequence
  Oligonucleotide probe
  misc_binding (1)..(18): Hybridization probe for the specific detection of mutant HIV-1 at codon 70 of the reverse transcriptase gene.
ayagyacyartggagraa

SEQ ID NO: 7159 - DNA, 17 bp, Artificial Sequence
  Oligonucleotide probe
  misc_binding (1)..(17): Hybridization probe for the specific detection of mutant HIV-1 at codon 70 of the reverse transcriptase gene.
ayagyacyartggagra

SEQ ID NO: 7160 - DNA, 17 bp, Artificial Sequence
  Oligonucleotide probe
  misc_binding (1)..(17): Hybridization probe for the specific detection of mutant HIV-1 at codon 70 of the reverse transcriptase gene.
yagyacyartggagraa

SEQ ID NO: 7161 - DNA, 15 bp, Artificial Sequence
  Oligonucleotide probe
  misc_binding (1)..(15): Hybridization probe for the specific detection of mutant HIV-1 at codon 70 of the reverse transcriptase gene.
ayagyacyartggag

SEQ ID NO: 7162 - DNA, 15 bp, Artificial Sequence
  Oligonucleotide probe
  misc_binding (1)..(15): Hybridization probe for the specific detection of mutant HIV-1 at codon 70 of the reverse transcriptase gene.
yagyacyartggagr

SEQ ID NO: 7163 - DNA, 16 bp, Artificial Sequence
  Oligonucleotide probe
  misc_binding (1)..(16): Hybridization probe for the specific detection of mutant HIV-1 at codon 70 of the reverse transcriptase gene.
ayagyacyartggagr

SEQ ID NO: 7164 - DNA, 13 bp, Artificial Sequence
  Oligonucleotide probe
  misc_binding (1)..(13): Hybridization probe for the specific detection of mutant HIV-1 at codon 70 of the reverse transcriptase gene.
ayagyacyartgg

SEQ ID NO: 7165 - DNA, 13 bp, Artificial Sequence
  Oligonucleotide probe
  misc_binding (1)..(13): Hybridization probe for the specific detection of mutant HIV-1 at codon 70 of the reverse transcriptase gene.
yagyacyartgga

SEQ ID NO: 7166 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (12)..(12): base is a locked nucleic acid
tggagraaatagtagayt

SEQ ID NO: 7167 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (11)..(11): base is a locked nucleic acid
tggagraaatagtagayt

SEQ ID NO: 7168 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (18)..(18): base is a locked nucleic acid
tggagraaatagtagayt

SEQ ID NO: 7169 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (13)..(13): base is a locked nucleic acid
tggagraaatagtagayt

SEQ ID NO: 7170 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (9)..(9): base is a locked nucleic acid
tggagraaatagtagayt

SEQ ID NO: 7171 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (2)..(2): base is a locked nucleic acid
tggagraaatagtagayt

SEQ ID NO: 7172 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (8)..(8): base is a locked nucleic acid
tggagraaatagtagayt

SEQ ID NO: 7173 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (3)..(3): base is a locked nucleic acid
tggagraaatagtagayt

SEQ ID NO: 7174 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (9)..(9): base is a locked nucleic acid
  modified_base (10)..(10): base is a locked nucleic acid
  modified_base (12)..(12): base is a locked nucleic acid
tggagraaatagtagayt

SEQ ID NO: 7175 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (9)..(9): base is a locked nucleic acid
  modified_base (10)..(10): base is a locked nucleic acid
  modified_base (14)..(14): base is a locked nucleic acid
tggagraaatagtagayt

SEQ ID NO: 7176 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (9)..(9): base is a locked nucleic acid
  modified_base (10)..(10): base is a locked nucleic acid
  modified_base (15)..(15): base is a locked nucleic acid
tggagraaatagtagayt

SEQ ID NO: 7177 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (9)..(9): base is a locked nucleic acid
  modified_base (10)..(10): base is a locked nucleic acid
  modified_base (18)..(18): base is a locked nucleic acid
tggagraaatagtagayt

SEQ ID NO: 7178 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (2)..(2): base is a locked nucleic acid
  modified_base (9)..(9): base is a locked nucleic acid
  modified_base (10)..(10): base is a locked nucleic acid
tggagraaatagtagayt

SEQ ID NO: 7179 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (4)..(4): base is a locked nucleic acid
  modified_base (9)..(9): base is a locked nucleic acid
  modified_base (10)..(10): base is a locked nucleic acid
tggagraaatagtagayt

SEQ ID NO: 7180 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (5)..(5): base is a locked nucleic acid
  modified_base (9)..(9): base is a locked nucleic acid
  modified_base (10)..(10): base is a locked nucleic acid
tggagraaatagtagayt

SEQ ID NO: 7181 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (3)..(3): base is a locked nucleic acid
  modified_base (9)..(9): base is a locked nucleic acid
  modified_base (10)..(10): base is a locked nucleic acid
tggagraaatagtagayt

SEQ ID NO: 7182 - DNA, 18 bp, Artificial Sequence
  Oligonucleotide probe
  misc_binding (1)..(18): Hybridization probe for the specific detection of mutant HIV-1 at codon 74 of the reverse transcriptase gene.
  modified_base (9)..(9): base is a locked nucleic acid
  modified_base (10)..(10): base is a locked nucleic acid
tggagraaatagtagayt

SEQ ID NO: 7183 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (11)..(11): base is a locked nucleic acid
ggagraaatagtagayt

SEQ ID NO: 7184 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (10)..(10): base is a locked nucleic acid
ggagraaatagtagayt

SEQ ID NO: 7185 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (17)..(17): base is a locked nucleic acid
ggagraaatagtagayt

SEQ ID NO: 7186 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (12)..(12): base is a locked nucleic acid
ggagraaatagtagayt

SEQ ID NO: 7187 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (8)..(8): base is a locked nucleic acid
ggagraaatagtagayt

SEQ ID NO: 7188 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (1)..(1): base is a locked nucleic acid
ggagraaatagtagayt

SEQ ID NO: 7189 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (7)..(7): base is a locked nucleic acid
ggagraaatagtagayt

SEQ ID NO: 7190 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (2)..(2): base is a locked nucleic acid
ggagraaatagtagayt

SEQ ID NO: 7191 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (11)..(11): base is a locked nucleic acid
ggagraaatagtagayt

SEQ ID NO: 7192 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (13)..(13): base is a locked nucleic acid
ggagraaatagtagayt

SEQ ID NO: 7193 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (14)..(14): base is a locked nucleic acid
ggagraaatagtagayt

SEQ ID NO: 7194 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (17)..(17): base is a locked nucleic acid
ggagraaatagtagayt

SEQ ID NO: 7195 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (1)..(1): base is a locked nucleic acid
  modified_base (8)..(8): base is a locked nucleic acid
  modified_base (9)..(9): base is a locked nucleic acid
ggagraaatagtagayt

SEQ ID NO: 7196 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (3)..(3): base is a locked nucleic acid
  modified_base (8)..(8): base is a locked nucleic acid
  modified_base (9)..(9): base is a locked nucleic acid
ggagraaatagtagayt

SEQ ID NO: 7197 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (4)..(4): base is a locked nucleic acid
  modified_base (8)..(8): base is a locked nucleic acid
  modified_base (9)..(9): base is a locked nucleic acid
ggagraaatagtagayt

SEQ ID NO: 7198 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (2)..(2): base is a locked nucleic acid
  modified_base (8)..(8): base is a locked nucleic acid
  modified_base (9)..(9): base is a locked nucleic acid
ggagraaatagtagayt

SEQ ID NO: 7199 - DNA, 17 bp, Artificial Sequence
  Oligonucleotide probe
  misc_binding (1)..(17): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
ggagraaatagtagayt

SEQ ID NO: 7200 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (11)..(11): base is a locked nucleic acid
ggagraaatagtaga

SEQ ID NO: 7201 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (10)..(10): base is a locked nucleic acid
ggagraaatagtaga

SEQ ID NO: 7202 - DNA, 16 bp, Artificial Sequence
  Oligonucleotide probe
  misc_binding (1)..(16): Hybridization probe for the specific detection of mutant HIV-1 at codon 74 of the reverse transcriptase gene.
ggagraaatagtagay

SEQ ID NO: 7203 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (12)..(12): base is a locked nucleic acid
ggagraaatagtaga

SEQ ID NO: 7204 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (8)..(8): base is a locked nucleic acid
ggagraaatagtaga

SEQ ID NO: 7205 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (1)..(1): base is a locked nucleic acid
ggagraaatagtaga

SEQ ID NO: 7206 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (7)..(7): base is a locked nucleic acid
ggagraaatagtaga

SEQ ID NO: 7207 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (2)..(2): base is a locked nucleic acid
ggagraaatagtaga

SEQ ID NO: 7208 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (11)..(11): base is a locked nucleic acid
ggagraaatagtaga

SEQ ID NO: 7209 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (13)..(13): base is a locked nucleic acid
ggagraaatagtaga

SEQ ID NO: 7210 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (14)..(14): base is a locked nucleic acid
ggagraaatagtaga

SEQ ID NO: 7211 - DNA, 16 bp, Artificial Sequence
  Oligonucleotide probe
  misc_binding (1)..(16): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
ggagraaatagtagay

SEQ ID NO: 7212 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (1)..(1): base is a locked nucleic acid
  modified_base (8)..(8): base is a locked nucleic acid
  modified_base (9)..(9): base is a locked nucleic acid
ggagraaatagtaga

SEQ ID NO: 7213 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (3)..(3): base is a locked nucleic acid
  modified_base (8)..(8): base is a locked nucleic acid
  modified_base (9)..(9): base is a locked nucleic acid
ggagraaatagtaga

SEQ ID NO: 7214 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (4)..(4): base is a locked nucleic acid
  modified_base (8)..(8): base is a locked nucleic acid
  modified_base (9)..(9): base is a locked nucleic acid
ggagraaatagtaga

SEQ ID NO: 7215 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (2)..(2): base is a locked nucleic acid
  modified_base (8)..(8): base is a locked nucleic acid
  modified_base (9)..(9): base is a locked nucleic acid
ggagraaatagtaga

SEQ ID NO: 7216 - DNA, 15 bp, Artificial Sequence
  Oligonucleotide probe
  misc_binding (1)..(15): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
ggagraaatagtaga

SEQ ID NO: 7217 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (11)..(11): base is a locked nucleic acid
ggagraaatagta

SEQ ID NO: 7218 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (10)..(10): base is a locked nucleic acid
ggagraaatagta

SEQ ID NO: 7219 - DNA, 14 bp, Artificial Sequence
  Oligonucleotide probe
  misc_binding (1)..(14): Hybridization probe for the specific detection of mutant HIV-1 at codon 74 of the reverse transcriptase gene.
ggagraaatagtag

SEQ ID NO: 7220 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (12)..(12): base is a locked nucleic acid
ggagraaatagta

SEQ ID NO: 7221 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (8)..(8): base is a locked nucleic acid
ggagraaatagta

SEQ ID NO: 7222 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (1)..(1): base is a locked nucleic acid
ggagraaatagta

SEQ ID NO: 7223 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (7)..(7): base is a locked nucleic acid
ggagraaatagta

SEQ ID NO: 7224 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (2)..(2): base is a locked nucleic acid
ggagraaatagta

SEQ ID NO: 7225 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (11)..(11): base is a locked nucleic acid
ggagraaatagta

SEQ ID NO: 7226 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
  modified_base (13)..(13): base is a locked nucleic acid
ggagraaatagta

SEQ ID NO: 7227 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
ggagraaatagta

SEQ ID NO: 7228 - DNA, 14 bp, Artificial Sequence
  Oligonucleotide probe
  misc_binding (1)..(14): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
ggagraaatagtag

SEQ ID NO: 7229 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (1)..(1): base is a locked nucleic acid
  modified_base (8)..(8): base is a locked nucleic acid
  modified_base (9)..(9): base is a locked nucleic acid
ggagraaatagta

SEQ ID NO: 7230 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (3)..(3): base is a locked nucleic acid
  modified_base (8)..(8): base is a locked nucleic acid
  modified_base (9)..(9): base is a locked nucleic acid
ggagraaatagta

SEQ ID NO: 7231 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (4)..(4): base is a locked nucleic acid
  modified_base (8)..(8): base is a locked nucleic acid
  modified_base (9)..(9): base is a locked nucleic acid
ggagraaatagta

SEQ ID NO: 7232 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (2)..(2): base is a locked nucleic acid
  modified_base (8)..(8): base is a locked nucleic acid
  modified_base (9)..(9): base is a locked nucleic acid
ggagraaatagta

SEQ ID NO: 7233 - DNA, 13 bp, Artificial Sequence
  Oligonucleotide probe
  misc_binding (1)..(13): Hybridization probe for the specific detection of mutant HIV-1 at codon 74 of the reverse transcriptase gene.
  modified_base (8)..(8): base is a locked nucleic acid
  modified_base (9)..(9): base is a locked nucleic acid
ggagraaatagta

SEQ ID NO: 7234 - DNA, 15 bp, Artificial Sequence
  Oligonucleotide probe
  misc_binding (1)..(15): Hybridization probe for the specific detection of mutant HIV-1 at codon 74 of the reverse transcriptase gene.
atctacyacttttct

SEQ ID NO: 7235 - DNA, 15 bp, Artificial Sequence
  Oligonucleotide probe
  misc_binding (1)..(15): Hybridization probe for the specific detection of mutant HIV-1 at codon 74 of the reverse transcriptase gene.
atctactatttttct

SEQ ID NO: 7236 - DNA, 18 bp, Artificial Sequence
  Oligonucleotide probe
  misc_binding (1)..(18): Hybridization probe for the specific detection of mutant HIV-1 at codon 74 of the reverse transcriptase gene.
tggagraaatagtagayt

SEQ ID NO: 7237 - DNA, 17 bp, Artificial Sequence
  Oligonucleotide probe
  misc_binding (1)..(17): Hybridization probe for the specific detection of mutant HIV-1 at codon 74 of the reverse transcriptase gene.
ggagraaatagtagayt

SEQ ID NO: 7238 - DNA, 15 bp, Artificial Sequence
  Oligonucleotide probe
  misc_binding (1)..(15): Hybridization probe for the specific detection of mutant HIV-1 at codon 74 of the reverse transcriptase gene.
ggagraaatagtaga

SEQ ID NO: 7239 - DNA, 13 bp, Artificial Sequence
  Oligonucleotide probe
  misc_binding (1)..(13): Hybridization probe for the specific detection of mutant HIV-1 at codon 74 of the reverse transcriptase gene.
ggagraaatagta

SEQ ID NO: 7240 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (11)..(11): base is a locked nucleic acid
agraaattatagayttya

SEQ ID NO: 7241 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (12)..(12): base is a locked nucleic acid
graaattagagayttyag

SEQ ID NO: 7242 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (10)..(10): base is a locked nucleic acid
agraaattatagayttya

SEQ ID NO: 7243 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (11)..(11): base is a locked nucleic acid
graaattagagayttyag

SEQ ID NO: 7244 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (16)..(16): base is a locked nucleic acid
agraaattatagayttya

SEQ ID NO: 7245 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (18)..(18): base is a locked nucleic acid
graaattagagayttyag

SEQ ID NO: 7246 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (15)..(15): base is a locked nucleic acid
agraaattatagayttya

SEQ ID NO: 7247 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (13)..(13): base is a locked nucleic acid
graaattagagayttyag

SEQ ID NO: 7248 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (5)..(5): base is a locked nucleic acid
agraaattatagayttya

SEQ ID NO: 7249 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
graaattagagayttyag

SEQ ID NO: 7250 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (4)..(4): base is a locked nucleic acid
agraaattatagayttya

SEQ ID NO: 7251 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (2)..(2): base is a locked nucleic acid
graaattagagayttyag

SEQ ID NO: 7252 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (7)..(7): base is a locked nucleic acid
agraaattatagayttya

SEQ ID NO: 7253 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (8)..(8): base is a locked nucleic acid
graaattagagayttyag

SEQ ID NO: 7254 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (2)..(2): base is a locked nucleic acid
agraaattatagayttya

SEQ ID NO: 7255 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (3)..(3): base is a locked nucleic acid
graaattagagayttyag

SEQ ID NO: 7256 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (13)..(13): base is a locked nucleic acid
agraaattatagayttya

SEQ ID NO: 7257 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (12)..(12): base is a locked nucleic acid
graaattagagayttyag

SEQ ID NO: 7258 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (17)..(17): base is a locked nucleic acid
agraaattatagayttya

SEQ ID NO: 7259 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (14)..(14): base is a locked nucleic acid
graaattagagayttyag

SEQ ID NO: 7260 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (14)..(14): base is a locked nucleic acid
agraaattatagayttya

SEQ ID NO: 7261 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (15)..(15): base is a locked nucleic acid
graaattagagayttyag

SEQ ID NO: 7262 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (11)..(11): base is a locked nucleic acid
agraaattatagayttya

SEQ ID NO: 7263 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
  modified_base (18)..(18): base is a locked nucleic acid
graaattagagayttyag

SEQ ID NO: 7264 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (7)..(7): base is a locked nucleic acid
  modified_base (9)..(9): base is a locked nucleic acid
  modified_base (10)..(10): base is a locked nucleic acid
agraaattatagayttya

SEQ ID NO: 7265 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (2)..(2): base is a locked nucleic acid
  modified_base (9)..(9): base is a locked nucleic acid
  modified_base (10)..(10): base is a locked nucleic acid
graaattagagayttyag

SEQ ID NO: 7266 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (3)..(3): base is a locked nucleic acid
  modified_base (9)..(9): base is a locked nucleic acid
  modified_base (10)..(10): base is a locked nucleic acid
agraaattatagayttya

SEQ ID NO: 7267 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (4)..(4): base is a locked nucleic acid
  modified_base (9)..(9): base is a locked nucleic acid
  modified_base (10)..(10): base is a locked nucleic acid
graaattagagayttyag

SEQ ID NO: 7268 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (10)..(10): base is a locked nucleic acid
agraaattatagayttya

SEQ ID NO: 7269 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (5)..(5): base is a locked nucleic acid
  modified_base (9)..(9): base is a locked nucleic acid
  modified_base (10)..(10): base is a locked nucleic acid
graaattagagayttyag

SEQ ID NO: 7270 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (2)..(2): base is a locked nucleic acid
  modified_base (9)..(9): base is a locked nucleic acid
  modified_base (10)..(10): base is a locked nucleic acid
agraaattatagayttya

SEQ ID NO: 7271 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (3)..(3): base is a locked nucleic acid
  modified_base (9)..(9): base is a locked nucleic acid
  modified_base (10)..(10): base is a locked nucleic acid
graaattagagayttyag

SEQ ID NO: 7272 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
agraaattatagayttya

SEQ ID NO: 7273 - DNA, 18 bp, Artificial Sequence
  Oligonucleotide probe
  misc_binding (1)..(18): Hybridization probe for the specific detection of mutant HIV-1 at codon 75 of the reverse transcriptase gene.
  modified_base (9)..(9): base is a locked nucleic acid
  modified_base (10)..(10): base is a locked nucleic acid
graaattagagayttyag

SEQ ID NO: 7274 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (10)..(10): base is a locked nucleic acid
graaattatagayttya

SEQ ID NO: 7275 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (11)..(11): base is a locked nucleic acid
raaattagagayttyag

SEQ ID NO: 7276 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (9)..(9): base is a locked nucleic acid
graaattatagayttya

SEQ ID NO: 7277 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (10)..(10): base is a locked nucleic acid
raaattagagayttyag

SEQ ID NO: 7278 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (15)..(15): base is a locked nucleic acid
graaattatagayttya

SEQ ID NO: 7279 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (17)..(17): base is a locked nucleic acid
raaattagagayttyag

SEQ ID NO: 7280 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (14)..(14): base is a locked nucleic acid
graaattatagayttya

SEQ ID NO: 7281 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (12)..(12): base is a locked nucleic acid
raaattagagayttyag

SEQ ID NO: 7282 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (4)..(4): base is a locked nucleic acid
graaattatagayttya

SEQ ID NO: 7283 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
raaattagagayttyag

SEQ ID NO: 7284 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (3)..(3): base is a locked nucleic acid
graaattatagayttya

SEQ ID NO: 7285 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (1)..(1): base is a locked nucleic acid
raaattagagayttyag

SEQ ID NO: 7286 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (6)..(6): base is a locked nucleic acid
graaattatagayttya

SEQ ID NO: 7287 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (7)..(7): base is a locked nucleic acid
raaattagagayttyag

SEQ ID NO: 7288 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (1)..(1): base is a locked nucleic acid
graaattatagayttya

SEQ ID NO: 7289 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (2)..(2): base is a locked nucleic acid
raaattagagayttyag

SEQ ID NO: 7290 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (12)..(12): base is a locked nucleic acid
graaattatagayttya

SEQ ID NO: 7291 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (11)..(11): base is a locked nucleic acid
raaattagagayttyag

SEQ ID NO: 7292 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (16)..(16): base is a locked nucleic acid
graaattatagayttya

SEQ ID NO: 7293 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (13)..(13): base is a locked nucleic acid
raaattagagayttyag

SEQ ID NO: 7294 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (13)..(13): base is a locked nucleic acid
graaattatagayttya

SEQ ID NO: 7295 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (14)..(14): base is a locked nucleic acid
raaattagagayttyag

SEQ ID NO: 7296 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (10)..(10): base is a locked nucleic acid
graaattatagayttya

SEQ ID NO: 7297 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (17)..(17): base is a locked nucleic acid
raaattagagayttyag

SEQ ID NO: 7298 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (6)..(6): base is a locked nucleic acid
  modified_base (8)..(8): base is a locked nucleic acid
  modified_base (9)..(9): base is a locked nucleic acid
graaattatagayttya

SEQ ID NO: 7299 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (1)..(1): base is a locked nucleic acid
  modified_base (8)..(8): base is a locked nucleic acid
  modified_base (9)..(9): base is a locked nucleic acid
raaattagagayttyag

SEQ ID NO: 7300 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (2)..(2): base is a locked nucleic acid
  modified_base (8)..(8): base is a locked nucleic acid
  modified_base (9)..(9): base is a locked nucleic acid
graaattatagayttya

SEQ ID NO: 7301 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (3)..(3): base is a locked nucleic acid
  modified_base (8)..(8): base is a locked nucleic acid
  modified_base (9)..(9): base is a locked nucleic acid
raaattagagayttyag

SEQ ID NO: 7302 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (7)..(7): base is a locked nucleic acid
  modified_base (8)..(8): base is a locked nucleic acid
  modified_base (9)..(9): base is a locked nucleic acid
graaattatagayttya

SEQ ID NO: 7303 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (4)..(4): base is a locked nucleic acid
  modified_base (8)..(8): base is a locked nucleic acid
  modified_base (9)..(9): base is a locked nucleic acid
raaattagagayttyag

SEQ ID NO: 7304 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (1)..(1): base is a locked nucleic acid
  modified_base (8)..(8): base is a locked nucleic acid
  modified_base (9)..(9): base is a locked nucleic acid
graaattatagayttya

SEQ ID NO: 7305 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (2)..(2): base is a locked nucleic acid
  modified_base (8)..(8): base is a locked nucleic acid
  modified_base (9)..(9): base is a locked nucleic acid
raaattagagayttyag

SEQ ID NO: 7306 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
graaattatagayttya

SEQ ID NO: 7307 - DNA, 17 bp, Artificial Sequence
  Oligonucleotide probe
  misc_binding (1)..(17): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
raaattagagayttyag

SEQ ID NO: 7308 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (10)..(10): base is a locked nucleic acid
graaattatagaytt

SEQ ID NO: 7309 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (11)..(11): base is a locked nucleic acid
raaattagagaytty

SEQ ID NO: 7310 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (9)..(9): base is a locked nucleic acid
graaattatagaytt

SEQ ID NO: 7311 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (10)..(10): base is a locked nucleic acid
raaattagagaytty

SEQ ID NO: 7312 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (15)..(15): base is a locked nucleic acid
graaattatagaytt

SEQ ID NO: 7313 - DNA, 16 bp, Artificial Sequence
  Oligonucleotide probe
  misc_binding (1)..(16): Hybridization probe for the specific detection of mutant HIV-1 at codon 75 of the reverse transcriptase gene.
raaattagagayttya

SEQ ID NO: 7314 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (14)..(14): base is a locked nucleic acid
graaattatagaytt

SEQ ID NO: 7315 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (12)..(12): base is a locked nucleic acid
raaattagagaytty

SEQ ID NO: 7316 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (4)..(4): base is a locked nucleic acid
graaattatagaytt

SEQ ID NO: 7317 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
raaattagagaytty

SEQ ID NO: 7318 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (3)..(3): base is a locked nucleic acid
graaattatagaytt

SEQ ID NO: 7319 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (1)..(1): base is a locked nucleic acid
raaattagagaytty

SEQ ID NO: 7320 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (6)..(6): base is a locked nucleic acid
graaattatagaytt

SEQ ID NO: 7321 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (7)..(7): base is a locked nucleic acid
raaattagagaytty

SEQ ID NO: 7322 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (1)..(1): base is a locked nucleic acid
graaattatagaytt

SEQ ID NO: 7323 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (2)..(2): base is a locked nucleic acid
raaattagagaytty

SEQ ID NO: 7324 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (12)..(12): base is a locked nucleic acid
graaattatagaytt

SEQ ID NO: 7325 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (11)..(11): base is a locked nucleic acid
raaattagagaytty

SEQ ID NO: 7326 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
graaattatagaytt

SEQ ID NO: 7327 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (13)..(13): base is a locked nucleic acid
raaattagagaytty

SEQ ID NO: 7328 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (13)..(13): base is a locked nucleic acid
graaattatagaytt

SEQ ID NO: 7329 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (14)..(14): base is a locked nucleic acid
raaattagagaytty

SEQ ID NO: 7330 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (10)..(10): base is a locked nucleic acid
graaattatagaytt

SEQ ID NO: 7331 - DNA, 16 bp, Artificial Sequence
  Oligonucleotide probe
  misc_binding (1)..(16): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
raaattagagayttya

SEQ ID NO: 7332 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (6)..(6): base is a locked nucleic acid
  modified_base (8)..(8): base is a locked nucleic acid
  modified_base (9)..(9): base is a locked nucleic acid
graaattatagaytt

SEQ ID NO: 7333 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (1)..(1): base is a locked nucleic acid
  modified_base (8)..(8): base is a locked nucleic acid
  modified_base (9)..(9): base is a locked nucleic acid
raaattagagaytty

SEQ ID NO: 7334 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (2)..(2): base is a locked nucleic acid
  modified_base (8)..(8): base is a locked nucleic acid
  modified_base (9)..(9): base is a locked nucleic acid
graaattatagaytt

SEQ ID NO: 7335 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (3)..(3): base is a locked nucleic acid
  modified_base (8)..(8): base is a locked nucleic acid
  modified_base (9)..(9): base is a locked nucleic acid
raaattagagaytty

SEQ ID NO: 7336 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (7)..(7): base is a locked nucleic acid
  modified_base (8)..(8): base is a locked nucleic acid
  modified_base (9)..(9): base is a locked nucleic acid
graaattatagaytt

SEQ ID NO: 7337 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (4)..(4): base is a locked nucleic acid
  modified_base (8)..(8): base is a locked nucleic acid
  modified_base (9)..(9): base is a locked nucleic acid
raaattagagaytty

SEQ ID NO: 7338 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (1)..(1): base is a locked nucleic acid
  modified_base (8)..(8): base is a locked nucleic acid
  modified_base (9)..(9): base is a locked nucleic acid
graaattatagaytt

SEQ ID NO: 7339 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (2)..(2): base is a locked nucleic acid
  modified_base (8)..(8): base is a locked nucleic acid
  modified_base (9)..(9): base is a locked nucleic acid
raaattagagaytty

SEQ ID NO: 7340 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
graaattatagaytt

SEQ ID NO: 7341 - DNA, 15 bp, Artificial Sequence
  Oligonucleotide probe
  misc_binding (1)..(15): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
raaattagagaytty

SEQ ID NO: 7342 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (10)..(10): base is a locked nucleic acid
graaattatagay

SEQ ID NO: 7343 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (11)..(11): base is a locked nucleic acid
raaattagagayt

SEQ ID NO: 7344 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (9)..(9): base is a locked nucleic acid
graaattatagay

SEQ ID NO: 7345 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (10)..(10): base is a locked nucleic acid
raaattagagayt

SEQ ID NO: 7346 - DNA, 14 bp, Artificial Sequence
  Oligonucleotide probe
  misc_binding (1)..(14): Hybridization probe for the specific detection of mutant HIV-1 at codon 75 of the reverse transcriptase gene.
graaattatagayt

SEQ ID NO: 7347 - DNA, 14 bp, Artificial Sequence
  Oligonucleotide probe
  misc_binding (1)..(14): Hybridization probe for the specific detection of mutant HIV-1 at codon 75 of the reverse transcriptase gene.
raaattagagaytt

SEQ ID NO: 7348 - DNA, 13 bp, Artificial Sequence
  Oligonucleotide probe
  misc_binding (1)..(13): Hybridization probe for the specific detection of mutant HIV-1 at codon 75 of the reverse transcriptase gene.
graaattatagay

SEQ ID NO: 7349 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (12)..(12): base is a locked nucleic acid
raaattagagayt

SEQ ID NO: 7350 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (4)..(4): base is a locked nucleic acid
graaattatagay

SEQ ID NO: 7351 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
raaattagagayt

SEQ ID NO: 7352 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (3)..(3): base is a locked nucleic acid
graaattatagay

SEQ ID NO: 7353 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (1)..(1): base is a locked nucleic acid
raaattagagayt

SEQ ID NO: 7354 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (6)..(6): base is a locked nucleic acid
graaattatagay

SEQ ID NO: 7355 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (7)..(7): base is a locked nucleic acid
raaattagagayt

SEQ ID NO: 7356 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (1)..(1): base is a locked nucleic acid
graaattatagay

SEQ ID NO: 7357 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (2)..(2): base is a locked nucleic acid
raaattagagayt

SEQ ID NO: 7358 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (12)..(12): base is a locked nucleic acid
graaattatagay

SEQ ID NO: 7359 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (11)..(11): base is a locked nucleic acid
raaattagagayt

SEQ ID NO: 7360 - DNA, 14 bp, Artificial Sequence
  Oligonucleotide probe
  misc_binding (1)..(14): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
graaattatagayt

SEQ ID NO: 7361 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (13)..(13): base is a locked nucleic acid
raaattagagayt

SEQ ID NO: 7362 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (13)..(13): base is a locked nucleic acid
graaattatagay

SEQ ID NO: 7363 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
raaattagagayt

SEQ ID NO: 7364 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
  modified_base (10)..(10): base is a locked nucleic acid
graaattatagay

SEQ ID NO: 7365 - DNA, 14 bp, Artificial Sequence
  Oligonucleotide probe
  misc_binding (1)..(14): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
raaattagagaytt

SEQ ID NO: 7366 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (6)..(6): base is a locked nucleic acid
  modified_base (8)..(8): base is a locked nucleic acid
  modified_base (9)..(9): base is a locked nucleic acid
graaattatagay

SEQ ID NO: 7367 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (1)..(1): base is a locked nucleic acid
  modified_base (8)..(8): base is a locked nucleic acid
  modified_base (9)..(9): base is a locked nucleic acid
raaattagagayt

SEQ ID NO: 7368 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (2)..(2): base is a locked nucleic acid
  modified_base (8)..(8): base is a locked nucleic acid
  modified_base (9)..(9): base is a locked nucleic acid
graaattatagay

SEQ ID NO: 7369 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (3)..(3): base is a locked nucleic acid
  modified_base (8)..(8): base is a locked nucleic acid
  modified_base (9)..(9): base is a locked nucleic acid
raaattagagayt

SEQ ID NO: 7370 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (7)..(7): base is a locked nucleic acid
  modified_base (8)..(8): base is a locked nucleic acid
  modified_base (9)..(9): base is a locked nucleic acid
graaattatagay

SEQ ID NO: 7371 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (4)..(4): base is a locked nucleic acid
  modified_base (8)..(8): base is a locked nucleic acid
  modified_base (9)..(9): base is a locked nucleic acid
raaattagagayt

SEQ ID NO: 7372 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (1)..(1): base is a locked nucleic acid
  modified_base (8)..(8): base is a locked nucleic acid
  modified_base (9)..(9): base is a locked nucleic acid
graaattatagay

SEQ ID NO: 7373 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (2)..(2): base is a locked nucleic acid
  modified_base (8)..(8): base is a locked nucleic acid
  modified_base (9)..(9): base is a locked nucleic acid
raaattagagayt

SEQ ID NO: 7374 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
graaattatagay

SEQ ID NO: 7375 - DNA, 13 bp, Artificial Sequence
  Oligonucleotide probe
  misc_binding (1)..(13): Hybridization probe for the specific detection of mutant HIV-1 at codon 75 of the reverse transcriptase gene.
  modified_base (8)..(8): base is a locked nucleic acid
  modified_base (9)..(9): base is a locked nucleic acid
raaattagagayt

SEQ ID NO: 7376 - DNA, 15 bp, Artificial Sequence
  Oligonucleotide probe
  misc_binding (1)..(15): Hybridization probe for the specific detection of mutant HIV-1 at codon 75 of the reverse transcriptase gene.
aaattaatggatttc

SEQ ID NO: 7377 - DNA, 15 bp, Artificial Sequence
  Oligonucleotide probe
  misc_binding (1)..(15): Hybridization probe for the specific detection of mutant HIV-1 at codon 75 of the reverse transcriptase gene.
aaattaacrgatttc

SEQ ID NO: 7378 - DNA, 15 bp, Artificial Sequence
  Oligonucleotide probe
  misc_binding (1)..(15): Hybridization probe for the specific detection of mutant HIV-1 at codon 75 of the reverse transcriptase gene.
aaattagcrgatttc

SEQ ID NO: 7379 - DNA, 15 bp, Artificial Sequence
  Oligonucleotide probe
  misc_binding (1)..(15): Hybridization probe for the specific detection of mutant HIV-1 at codon 75 of the reverse transcriptase gene.
aaattaagygatttc

SEQ ID NO: 7380 - DNA, 15 bp, Artificial Sequence
  Oligonucleotide probe
  misc_binding (1)..(15): Hybridization probe for the specific detection of mutant HIV-1 at codon 75 of the reverse transcriptase gene.
aaattaatagatttc

SEQ ID NO: 7381 - DNA, 18 bp, Artificial Sequence
  Oligonucleotide probe
  misc_binding (1)..(18): Hybridization probe for the specific detection of mutant HIV-1 at codon 75 of the reverse transcriptase gene.
agraaattatagayttya

SEQ ID NO: 7382 - DNA, 18 bp, Artificial Sequence
  Oligonucleotide probe
  misc_binding (1)..(18): Hybridization probe for the specific detection of mutant HIV-1 at codon 75 of the reverse transcriptase gene.
graaattagagayttyag

SEQ ID NO: 7383 - DNA, 17 bp, Artificial Sequence
  Oligonucleotide probe
  misc_binding (1)..(17): Hybridization probe for the specific detection of mutant HIV-1 at codon 75 of the reverse transcriptase gene.
graaattatagayttya

SEQ ID NO: 7384 - DNA, 17 bp, Artificial Sequence
  Oligonucleotide probe
  misc_binding (1)..(17): Hybridization probe for the specific detection of mutant HIV-1 at codon 75 of the reverse transcriptase gene.
raaattagagayttyag

SEQ ID NO: 7385 - DNA, 15 bp, Artificial Sequence
  Oligonucleotide probe
  misc_binding (1)..(15): Hybridization probe for the specific detection of mutant HIV-1 at codon 75 of the reverse transcriptase gene.
graaattatagaytt

SEQ ID NO: 7386 - DNA, 15 bp, Artificial Sequence
  Oligonucleotide probe
  misc_binding (1)..(15): Hybridization probe for the specific detection of mutant HIV-1 at codon 75 of the reverse transcriptase gene.
raaattagagaytty

SEQ ID NO: 7387 - DNA, 13 bp, Artificial Sequence
  Oligonucleotide probe
  misc_binding (1)..(13): Hybridization probe for the specific detection of mutant HIV-1 at codon 75 of the reverse transcriptase gene.
graaattatagay

SEQ ID NO: 7388 - DNA, 13 bp, Artificial Sequence
  Oligonucleotide probe
  misc_binding (1)..(13): Hybridization probe for the specific detection of mutant HIV-1 at codon 75 of the reverse transcriptase gene.
raaattagagayt

SEQ ID NO: 7389 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (18)..(18): base is a locked nucleic acid
agtagayttagrgarcty

SEQ ID NO: 7390 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (11)..(11): base is a locked nucleic acid
agtagayttagrgarcty

SEQ ID NO: 7391 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (12)..(12): base is a locked nucleic acid
agtagayttagrgarcty

SEQ ID NO: 7392 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (14)..(14): base is a locked nucleic acid
agtagayttagrgarcty

SEQ ID NO: 7393 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (5)..(5): base is a locked nucleic acid
agtagayttagrgarcty

SEQ ID NO: 7394 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (3)..(3): base is a locked nucleic acid
agtagayttagrgarcty

SEQ ID NO: 7395 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (2)..(2): base is a locked nucleic acid
agtagayttagrgarcty

SEQ ID NO: 7396 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (8)..(8): base is a locked nucleic acid
agtagayttagrgarcty

SEQ ID NO: 7397 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (9)..(9): base is a locked nucleic acid
  modified_base (10)..(10): base is a locked nucleic acid
  modified_base (12)..(12): base is a locked nucleic acid
agtagayttagrgarcty

SEQ ID NO: 7398 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (9)..(9): base is a locked nucleic acid
  modified_base (10)..(10): base is a locked nucleic acid
  modified_base (13)..(13): base is a locked nucleic acid
agtagayttagrgarcty

SEQ ID NO: 7399 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (9)..(9): base is a locked nucleic acid
  modified_base (10)..(10): base is a locked nucleic acid
  modified_base (18)..(18): base is a locked nucleic acid
agtagayttagrgarcty

SEQ ID NO: 7400 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (9)..(9): base is a locked nucleic acid
  modified_base (10)..(10): base is a locked nucleic acid
  modified_base (14)..(14): base is a locked nucleic acid
agtagayttagrgarcty

SEQ ID NO: 7401 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (7)..(7): base is a locked nucleic acid
  modified_base (9)..(9): base is a locked nucleic acid
  modified_base (10)..(10): base is a locked nucleic acid
agtagayttagrgarcty

SEQ ID NO: 7402 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (2)..(2): base is a locked nucleic acid
  modified_base (9)..(9): base is a locked nucleic acid
  modified_base (10)..(10): base is a locked nucleic acid
agtagayttagrgarcty

SEQ ID NO: 7403 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (5)..(5): base is a locked nucleic acid
  modified_base (9)..(9): base is a locked nucleic acid
  modified_base (10)..(10): base is a locked nucleic acid
agtagayttagrgarcty

SEQ ID NO: 7404 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (10)..(10): base is a locked nucleic acid
agtagayttagrgarcty

SEQ ID NO: 7405 - DNA, 18 bp, Artificial Sequence
  Oligonucleotide probe
  misc_binding (1)..(18): Hybridization probe for the specific detection of mutant HIV-1 at codon 77 of the reverse transcriptase gene.
  modified_base (9)..(9): base is a locked nucleic acid
  modified_base (10)..(10): base is a locked nucleic acid
agtagayttagrgarcty

SEQ ID NO: 7406 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (17)..(17): base is a locked nucleic acid
gtagayttagrgarcty

SEQ ID NO: 7407 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (10)..(10): base is a locked nucleic acid
gtagayttagrgarcty

SEQ ID NO: 7408 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (11)..(11): base is a locked nucleic acid
gtagayttagrgarcty

SEQ ID NO: 7409 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (13)..(13): base is a locked nucleic acid
gtagayttagrgarcty

SEQ ID NO: 7410 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (4)..(4): base is a locked nucleic acid
gtagayttagrgarcty

SEQ ID NO: 7411 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (2)..(2): base is a locked nucleic acid
gtagayttagrgarcty

SEQ ID NO: 7412 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (1)..(1): base is a locked nucleic acid
gtagayttagrgarcty

SEQ ID NO: 7413 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (7)..(7): base is a locked nucleic acid
gtagayttagrgarcty

SEQ ID NO: 7414 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (11)..(11): base is a locked nucleic acid
gtagayttagrgarcty

SEQ ID NO: 7415 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (12)..(12): base is a locked nucleic acid
gtagayttagrgarcty

SEQ ID NO: 7416 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (17)..(17): base is a locked nucleic acid
gtagayttagrgarcty

SEQ ID NO: 7417 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (13)..(13): base is a locked nucleic acid
gtagayttagrgarcty

SEQ ID NO: 7418 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (6)..(6): base is a locked nucleic acid
  modified_base (8)..(8): base is a locked nucleic acid
  modified_base (9)..(9): base is a locked nucleic acid
gtagayttagrgarcty

SEQ ID NO: 7419 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (1)..(1): base is a locked nucleic acid
  modified_base (8)..(8): base is a locked nucleic acid
  modified_base (9)..(9): base is a locked nucleic acid
gtagayttagrgarcty

SEQ ID NO: 7420 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (4)..(4): base is a locked nucleic acid
  modified_base (8)..(8): base is a locked nucleic acid
  modified_base (9)..(9): base is a locked nucleic acid
gtagayttagrgarcty

SEQ ID NO: 7421 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (7)..(7): base is a locked nucleic acid
  modified_base (8)..(8): base is a locked nucleic acid
  modified_base (9)..(9): base is a locked nucleic acid
gtagayttagrgarcty

SEQ ID NO: 7422 - DNA, 17 bp, Artificial Sequence
  Oligonucleotide probe
  misc_binding (1)..(17): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
gtagayttagrgarcty

SEQ ID NO: 7423 - DNA, 16 bp, Artificial Sequence
  Oligonucleotide probe
  misc_binding (1)..(16): Hybridization probe for the specific detection of mutant HIV-1 at codon 77 of the reverse transcriptase gene.
gtagayttagrgarct

SEQ ID NO: 7424 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (10)..(10): base is a locked nucleic acid
gtagayttagrgarc

SEQ ID NO: 7425 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (11)..(11): base is a locked nucleic acid
gtagayttagrgarc

SEQ ID NO: 7426 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (13)..(13): base is a locked nucleic acid
gtagayttagrgarc

SEQ ID NO: 7427 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (4)..(4): base is a locked nucleic acid
gtagayttagrgarc

SEQ ID NO: 7428 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (2)..(2): base is a locked nucleic acid
gtagayttagrgarc

SEQ ID NO: 7429 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (1)..(1): base is a locked nucleic acid
gtagayttagrgarc

SEQ ID NO: 7430 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (7)..(7): base is a locked nucleic acid
gtagayttagrgarc

SEQ ID NO: 7431 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (11)..(11): base is a locked nucleic acid
gtagayttagrgarc

SEQ ID NO: 7432 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (12)..(12): base is a locked nucleic acid
gtagayttagrgarc

SEQ ID NO: 7433 - DNA, 16 bp, Artificial Sequence
  Oligonucleotide probe
  misc_binding (1)..(16): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
gtagayttagrgarct

SEQ ID NO: 7434 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (13)..(13): base is a locked nucleic acid
gtagayttagrgarc

SEQ ID NO: 7435 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (6)..(6): base is a locked nucleic acid
  modified_base (8)..(8): base is a locked nucleic acid
  modified_base (9)..(9): base is a locked nucleic acid
gtagayttagrgarc

SEQ ID NO: 7436 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (1)..(1): base is a locked nucleic acid
  modified_base (8)..(8): base is a locked nucleic acid
  modified_base (9)..(9): base is a locked nucleic acid
gtagayttagrgarc

SEQ ID NO: 7437 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (4)..(4): base is a locked nucleic acid
  modified_base (8)..(8): base is a locked nucleic acid
  modified_base (9)..(9): base is a locked nucleic acid
gtagayttagrgarc

SEQ ID NO: 7438 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (7)..(7): base is a locked nucleic acid
  modified_base (8)..(8): base is a locked nucleic acid
  modified_base (9)..(9): base is a locked nucleic acid
gtagayttagrgarc

SEQ ID NO: 7439 - DNA, 15 bp, Artificial Sequence
  Oligonucleotide probe
  misc_binding (1)..(15): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
gtagayttagrgarc

SEQ ID NO: 7440 - DNA, 14 bp, Artificial Sequence
  Oligonucleotide probe
  misc_binding (1)..(14): Hybridization probe for the specific detection of mutant HIV-1 at codon 77 of the reverse transcriptase gene.
gtagayttagrgar

SEQ ID NO: 7441 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (10)..(10): base is a locked nucleic acid
gtagayttagrga

SEQ ID NO: 7442 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (11)..(11): base is a locked nucleic acid
gtagayttagrga

SEQ ID NO: 7443 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (13)..(13): base is a locked nucleic acid
gtagayttagrga

SEQ ID NO: 7444 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (4)..(4): base is a locked nucleic acid
gtagayttagrga

SEQ ID NO: 7445 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (2)..(2): base is a locked nucleic acid
gtagayttagrga

SEQ ID NO: 7446 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (1)..(1): base is a locked nucleic acid
gtagayttagrga

SEQ ID NO: 7447 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (7)..(7): base is a locked nucleic acid
gtagayttagrga

SEQ ID NO: 7448 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (11)..(11): base is a locked nucleic acid
gtagayttagrga

SEQ ID NO: 7449 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (12)..(12): base is a locked nucleic acid
gtagayttagrga

SEQ ID NO: 7450 - DNA, 14 bp, Artificial Sequence
  Oligonucleotide probe
  misc_binding (1)..(14): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
gtagayttagrgar

SEQ ID NO: 7451 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
  modified_base (13)..(13): base is a locked nucleic acid
gtagayttagrga

SEQ ID NO: 7452 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (6)..(6): base is a locked nucleic acid
  modified_base (8)..(8): base is a locked nucleic acid
  modified_base (9)..(9): base is a locked nucleic acid
gtagayttagrga

SEQ ID NO: 7453 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (1)..(1): base is a locked nucleic acid
  modified_base (8)..(8): base is a locked nucleic acid
  modified_base (9)..(9): base is a locked nucleic acid
gtagayttagrga

SEQ ID NO: 7454 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (4)..(4): base is a locked nucleic acid
  modified_base (8)..(8): base is a locked nucleic acid
  modified_base (9)..(9): base is a locked nucleic acid
gtagayttagrga

SEQ ID NO: 7455 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (7)..(7): base is a locked nucleic acid
  modified_base (8)..(8): base is a locked nucleic acid
  modified_base (9)..(9): base is a locked nucleic acid
gtagayttagrga

SEQ ID NO: 7456 - DNA, 13 bp, Artificial Sequence
  Oligonucleotide probe
  misc_binding (1)..(13): Hybridization probe for the specific detection of mutant HIV-1 at codon 77 of the reverse transcriptase gene.
  modified_base (8)..(8): base is a locked nucleic acid
  modified_base (9)..(9): base is a locked nucleic acid
gtagayttagrga

SEQ ID NO: 7457 - DNA, 15 bp, Artificial Sequence
  Oligonucleotide probe
  misc_binding (1)..(15): Hybridization probe for the specific detection of mutant HIV-1 at codon 77 of the reverse transcriptase gene.
ttctctragatctac

SEQ ID NO: 7458 - DNA, 15 bp, Artificial Sequence
  Oligonucleotide probe
  misc_binding (1)..(15): Hybridization probe for the specific detection of mutant HIV-1 at codon 77 of the reverse transcriptase gene.
ttctctyaaatctac

SEQ ID NO: 7459 - DNA, 18 bp, Artificial Sequence
  Oligonucleotide probe
  misc_binding (1)..(18): Hybridization probe for the specific detection of mutant HIV-1 at codon 77 of the reverse transcriptase gene.
agtagayttagrgarcty

SEQ ID NO: 7460 - DNA, 17 bp, Artificial Sequence
  Oligonucleotide probe
  misc_binding (1)..(17): Hybridization probe for the specific detection of mutant HIV-1 at codon 77 of the reverse transcriptase gene.
gtagayttagrgarcty

SEQ ID NO: 7461 - DNA, 15 bp, Artificial Sequence
  Oligonucleotide probe
  misc_binding (1)..(15): Hybridization probe for the specific detection of mutant HIV-1 at codon 77 of the reverse transcriptase gene.
gtagayttagrgarc

SEQ ID NO: 7462 - DNA, 13 bp, Artificial Sequence
  Oligonucleotide probe
  misc_binding (1)..(13): Hybridization probe for the specific detection of mutant HIV-1 at codon 77 of the reverse transcriptase gene.
gtagayttagrga

SEQ ID NO: 7463 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (12)..(12): base is a locked nucleic acid
ttytgggartycaattag

SEQ ID NO: 7464 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (11)..(11): base is a locked nucleic acid
ttytgggartycaattag

SEQ ID NO: 7465 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (18)..(18): base is a locked nucleic acid
ttytgggartycaattag

SEQ ID NO: 7466 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (14)..(14): base is a locked nucleic acid
ttytgggartycaattag

SEQ ID NO: 7467 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (5)..(5): base is a locked nucleic acid
ttytgggartycaattag

SEQ ID NO: 7468 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (9)..(9): base is a locked nucleic acid
ttytgggartycaattag

SEQ ID NO: 7469 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (3)..(3): base is a locked nucleic acid
ttytgggartycaattag

SEQ ID NO: 7470 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (2)..(2): base is a locked nucleic acid
ttytgggartycaattag

SEQ ID NO: 7471 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (9)..(9): base is a locked nucleic acid
  modified_base (10)..(10): base is a locked nucleic acid
  modified_base (18)..(18): base is a locked nucleic acid
ttytgggartycaattag

SEQ ID NO: 7472 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (9)..(9): base is a locked nucleic acid
  modified_base (10)..(10): base is a locked nucleic acid
  modified_base (14)..(14): base is a locked nucleic acid
ttytgggartycaattag

SEQ ID NO: 7473 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (9)..(9): base is a locked nucleic acid
  modified_base (10)..(10): base is a locked nucleic acid
  modified_base (11)..(11): base is a locked nucleic acid
ttytgggartycaattag

SEQ ID NO: 7474 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (9)..(9): base is a locked nucleic acid
  modified_base (10)..(10): base is a locked nucleic acid
  modified_base (16)..(16): base is a locked nucleic acid
ttytgggartycaattag

SEQ ID NO: 7475 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (5)..(5): base is a locked nucleic acid
  modified_base (9)..(9): base is a locked nucleic acid
  modified_base (10)..(10): base is a locked nucleic acid
ttytgggartycaattag

SEQ ID NO: 7476 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (3)..(3): base is a locked nucleic acid
  modified_base (9)..(9): base is a locked nucleic acid
  modified_base (10)..(10): base is a locked nucleic acid
ttytgggartycaattag

SEQ ID NO: 7477 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (6)..(6): base is a locked nucleic acid
  modified_base (9)..(9): base is a locked nucleic acid
  modified_base (10)..(10): base is a locked nucleic acid
ttytgggartycaattag

SEQ ID NO: 7478 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (7)..(7): base is a locked nucleic acid
  modified_base (9)..(9): base is a locked nucleic acid
  modified_base (10)..(10): base is a locked nucleic acid
ttytgggartycaattag

SEQ ID NO: 7479 - DNA, 18 bp, Artificial Sequence
  Oligonucleotide probe
  misc_binding (1)..(18): Hybridization probe for the specific detection of mutant HIV-1 at codon 90 of the reverse transcriptase gene.
  modified_base (9)..(9): base is a locked nucleic acid
  modified_base (10)..(10): base is a locked nucleic acid
ttytgggartycaattag

SEQ ID NO: 7480 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (11)..(11): base is a locked nucleic acid
tytgggartycaattag

SEQ ID NO: 7481 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (10)..(10): base is a locked nucleic acid
tytgggartycaattag

SEQ ID NO: 7482 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (17)..(17): base is a locked nucleic acid
tytgggartycaattag

SEQ ID NO: 7483 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (13)..(13): base is a locked nucleic acid
tytgggartycaattag

SEQ ID NO: 7484 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (4)..(4): base is a locked nucleic acid
tytgggartycaattag

SEQ ID NO: 7485 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (8)..(8): base is a locked nucleic acid
tytgggartycaattag

SEQ ID NO: 7486 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (2)..(2): base is a locked nucleic acid
tytgggartycaattag

SEQ ID NO: 7487 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (1)..(1): base is a locked nucleic acid
tytgggartycaattag

SEQ ID NO: 7488 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (17)..(17): base is a locked nucleic acid
tytgggartycaattag

SEQ ID NO: 7489 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (13)..(13): base is a locked nucleic acid
tytgggartycaattag

SEQ ID NO: 7490 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (10)..(10): base is a locked nucleic acid
tytgggartycaattag

SEQ ID NO: 7491 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (15)..(15): base is a locked nucleic acid
tytgggartycaattag

SEQ ID NO: 7492 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (4)..(4): base is a locked nucleic acid
  modified_base (8)..(8): base is a locked nucleic acid
  modified_base (9)..(9): base is a locked nucleic acid
tytgggartycaattag

SEQ ID NO: 7493 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (2)..(2): base is a locked nucleic acid
  modified_base (8)..(8): base is a locked nucleic acid
  modified_base (9)..(9): base is a locked nucleic acid
tytgggartycaattag

SEQ ID NO: 7494 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (5)..(5): base is a locked nucleic acid
  modified_base (8)..(8): base is a locked nucleic acid
  modified_base (9)..(9): base is a locked nucleic acid
tytgggartycaattag

SEQ ID NO: 7495 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (6)..(6): base is a locked nucleic acid
  modified_base (8)..(8): base is a locked nucleic acid
  modified_base (9)..(9): base is a locked nucleic acid
tytgggartycaattag

SEQ ID NO: 7496 - DNA, 17 bp, Artificial Sequence
  Oligonucleotide probe
  misc_binding (1)..(17): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
tytgggartycaattag

SEQ ID NO: 7497 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (11)..(11): base is a locked nucleic acid
tytgggartycaatt

SEQ ID NO: 7498 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (10)..(10): base is a locked nucleic acid
tytgggartycaatt

SEQ ID NO: 7499 - DNA, 16 bp, Artificial Sequence
  Oligonucleotide probe
  misc_binding (1)..(16): Hybridization probe for the specific detection of mutant HIV-1 at codon 90 of the reverse transcriptase gene.
tytgggartycaatta

SEQ ID NO: 7500 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (13)..(13): base is a locked nucleic acid
tytgggartycaatt

SEQ ID NO: 7501 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (4)..(4): base is a locked nucleic acid
tytgggartycaatt

SEQ ID NO: 7502 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (8)..(8): base is a locked nucleic acid
tytgggartycaatt

SEQ ID NO: 7503 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (2)..(2): base is a locked nucleic acid
tytgggartycaatt

SEQ ID NO: 7504 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (1)..(1): base is a locked nucleic acid
tytgggartycaatt

SEQ ID NO: 7505 - DNA, 16 bp, Artificial Sequence
  Oligonucleotide probe
  misc_binding (1)..(16): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
tytgggartycaatta

SEQ ID NO: 7506 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (13)..(13): base is a locked nucleic acid
tytgggartycaatt

SEQ ID NO: 7507 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (10)..(10): base is a locked nucleic acid
tytgggartycaatt

SEQ ID NO: 7508 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (15)..(15): base is a locked nucleic acid
tytgggartycaatt

SEQ ID NO: 7509 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (4)..(4): base is a locked nucleic acid
  modified_base (8)..(8): base is a locked nucleic acid
  modified_base (9)..(9): base is a locked nucleic acid
tytgggartycaatt

SEQ ID NO: 7510 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (2)..(2): base is a locked nucleic acid
  modified_base (8)..(8): base is a locked nucleic acid
  modified_base (9)..(9): base is a locked nucleic acid
tytgggartycaatt

SEQ ID NO: 7511 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (5)..(5): base is a locked nucleic acid
  modified_base (8)..(8): base is a locked nucleic acid
  modified_base (9)..(9): base is a locked nucleic acid
tytgggartycaatt

SEQ ID NO: 7512 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (6)..(6): base is a locked nucleic acid
  modified_base (8)..(8): base is a locked nucleic acid
  modified_base (9)..(9): base is a locked nucleic acid
tytgggartycaatt

SEQ ID NO: 7513 - DNA, 15 bp, Artificial Sequence
  Oligonucleotide probe
  misc_binding (1)..(15): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
tytgggartycaatt

SEQ ID NO: 7514 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (11)..(11): base is a locked nucleic acid
tytgggartycaa

SEQ ID NO: 7515 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (10)..(10): base is a locked nucleic acid
tytgggartycaa

SEQ ID NO: 7516 - DNA, 14 bp, Artificial Sequence
  Oligonucleotide probe
  misc_binding (1)..(14): Hybridization probe for the specific detection of mutant HIV-1 at codon 90 of the reverse transcriptase gene.
tytgggartycaat

SEQ ID NO: 7517 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (13)..(13): base is a locked nucleic acid
tytgggartycaa

SEQ ID NO: 7518 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (4)..(4): base is a locked nucleic acid
tytgggartycaa

SEQ ID NO: 7519 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (8)..(8): base is a locked nucleic acid
tytgggartycaa

SEQ ID NO: 7520 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (2)..(2): base is a locked nucleic acid
tytgggartycaa

SEQ ID NO: 7521 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (1)..(1): base is a locked nucleic acid
tytgggartycaa

SEQ ID NO: 7522 - DNA, 14 bp, Artificial Sequence
  Oligonucleotide probe
  misc_binding (1)..(14): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
tytgggartycaat

SEQ ID NO: 7523 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (13)..(13): base is a locked nucleic acid
tytgggartycaa

SEQ ID NO: 7524 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
  modified_base (10)..(10): base is a locked nucleic acid
tytgggartycaa

SEQ ID NO: 7525 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (4)..(4): base is a locked nucleic acid
  modified_base (8)..(8): base is a locked nucleic acid
  modified_base (9)..(9): base is a locked nucleic acid
tytgggartycaa

SEQ ID NO: 7526 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (2)..(2): base is a locked nucleic acid
  modified_base (8)..(8): base is a locked nucleic acid
  modified_base (9)..(9): base is a locked nucleic acid
tytgggartycaa

SEQ ID NO: 7527 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (5)..(5): base is a locked nucleic acid
  modified_base (8)..(8): base is a locked nucleic acid
  modified_base (9)..(9): base is a locked nucleic acid
tytgggartycaa

SEQ ID NO: 7528 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (6)..(6): base is a locked nucleic acid
  modified_base (8)..(8): base is a locked nucleic acid
  modified_base (9)..(9): base is a locked nucleic acid
tytgggartycaa

SEQ ID NO: 7529 - DNA, 13 bp, Artificial Sequence
  Oligonucleotide probe
  misc_binding (1)..(13): Hybridization probe for the specific detection of mutant HIV-1 at codon 90 of the reverse transcriptase gene.
  modified_base (8)..(8): base is a locked nucleic acid
  modified_base (9)..(9): base is a locked nucleic acid
tytgggartycaa

SEQ ID NO: 7530 - DNA, 15 bp, Artificial Sequence
  Oligonucleotide probe
  misc_binding (1)..(15): Hybridization probe for the specific detection of mutant HIV-1 at codon 90 of the reverse transcriptase gene.
ctgggaaatycaatt

SEQ ID NO: 7531 - DNA, 18 bp, Artificial Sequence
  Oligonucleotide probe
  misc_binding (1)..(18): Hybridization probe for the specific detection of mutant HIV-1 at codon 90 of the reverse transcriptase gene.
ttytgggartycaattag

SEQ ID NO: 7532 - DNA, 17 bp, Artificial Sequence
  Oligonucleotide probe
  misc_binding (1)..(17): Hybridization probe for the specific detection of mutant HIV-1 at codon 90 of the reverse transcriptase gene.
tytgggartycaattag

SEQ ID NO: 7533 - DNA, 15 bp, Artificial Sequence
  Oligonucleotide probe
  misc_binding (1)..(15): Hybridization probe for the specific detection of mutant HIV-1 at codon 90 of the reverse transcriptase gene.
tytgggartycaatt

SEQ ID NO: 7534 - DNA, 13 bp, Artificial Sequence
  Oligonucleotide probe
  misc_binding (1)..(13): Hybridization probe for the specific detection of mutant HIV-1 at codon 90 of the reverse transcriptase gene.
tytgggartycaa

SEQ ID NO: 7535 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (12)..(12): base is a locked nucleic acid
cncaycchgrggdytaaa

SEQ ID NO: 7536 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (14)..(14): base is a locked nucleic acid
cncaycchgrggdytaaa

SEQ ID NO: 7537 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (16)..(16): base is a locked nucleic acid
cncaycchgrggdytaaa

SEQ ID NO: 7538 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (18)..(18): base is a locked nucleic acid
cncaycchgrggdytaaa

SEQ ID NO: 7539 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (3)..(3): base is a locked nucleic acid
cncaycchgrggdytaaa

SEQ ID NO: 7540 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (4)..(4): base is a locked nucleic acid
cncaycchgrggdytaaa

SEQ ID NO: 7541 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (5)..(5): base is a locked nucleic acid
cncaycchgrggdytaaa

SEQ ID NO: 7542 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  modified_base (2)..(2): base is a locked nucleic acid
  misc_feature (2)..(2): n is a, c, g, or t
cncaycchgrggdytaaa

SEQ ID NO: 7543 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (9)..(9): base is a locked nucleic acid
  modified_base (10)..(10): base is a locked nucleic acid
  modified_base (12)..(12): base is a locked nucleic acid
cncaycchgrggdytaaa

SEQ ID NO: 7544 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (9)..(9): base is a locked nucleic acid
  modified_base (10)..(10): base is a locked nucleic acid
  modified_base (14)..(14): base is a locked nucleic acid
cncaycchgrggdytaaa

SEQ ID NO: 7545 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (9)..(9): base is a locked nucleic acid
  modified_base (10)..(10): base is a locked nucleic acid
  modified_base (11)..(11): base is a locked nucleic acid
cncaycchgrggdytaaa

SEQ ID NO: 7546 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (9)..(9): base is a locked nucleic acid
  modified_base (10)..(10): base is a locked nucleic acid
  modified_base (18)..(18): base is a locked nucleic acid
cncaycchgrggdytaaa

SEQ ID NO: 7547 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (6)..(6): base is a locked nucleic acid
  modified_base (9)..(9): base is a locked nucleic acid
  modified_base (10)..(10): base is a locked nucleic acid
cncaycchgrggdytaaa

SEQ ID NO: 7548 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (8)..(8): base is a locked nucleic acid
  modified_base (9)..(9): base is a locked nucleic acid
  modified_base (10)..(10): base is a locked nucleic acid
cncaycchgrggdytaaa

SEQ ID NO: 7549 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (3)..(3): base is a locked nucleic acid
  modified_base (9)..(9): base is a locked nucleic acid
  modified_base (10)..(10): base is a locked nucleic acid
cncaycchgrggdytaaa

SEQ ID NO: 7550 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (7)..(7): base is a locked nucleic acid
  modified_base (9)..(9): base is a locked nucleic acid
  modified_base (10)..(10): base is a locked nucleic acid
cncaycchgrggdytaaa

SEQ ID NO: 7551 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
  modified_base (9)..(9): base is a locked nucleic acid
  modified_base (10)..(10): base is a locked nucleic acid
cncaycchgrggdytaaa

SEQ ID NO: 7552 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (11)..(11): base is a locked nucleic acid
ncaycchgrggdytaaa

SEQ ID NO: 7553 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (13)..(13): base is a locked nucleic acid
ncaycchgrggdytaaa

SEQ ID NO: 7554 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (15)..(15): base is a locked nucleic acid
ncaycchgrggdytaaa

SEQ ID NO: 7555 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (17)..(17): base is a locked nucleic acid
ncaycchgrggdytaaa

SEQ ID NO: 7556 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (2)..(2): base is a locked nucleic acid
ncaycchgrggdytaaa

SEQ ID NO: 7557 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (3)..(3): base is a locked nucleic acid
ncaycchgrggdytaaa

SEQ ID NO: 7558 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (4)..(4): base is a locked nucleic acid
ncaycchgrggdytaaa

SEQ ID NO: 7559 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  modified_base (1)..(1): base is a locked nucleic acid
  misc_feature (1)..(1): n is a, c, g, or t
ncaycchgrggdytaaa

SEQ ID NO: 7560 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (11)..(11): base is a locked nucleic acid
ncaycchgrggdytaaa

SEQ ID NO: 7561 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (13)..(13): base is a locked nucleic acid
ncaycchgrggdytaaa

SEQ ID NO: 7562 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (10)..(10): base is a locked nucleic acid
ncaycchgrggdytaaa

SEQ ID NO: 7563 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (17)..(17): base is a locked nucleic acid
ncaycchgrggdytaaa

SEQ ID NO: 7564 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (5)..(5): base is a locked nucleic acid
  modified_base (8)..(8): base is a locked nucleic acid
  modified_base (9)..(9): base is a locked nucleic acid
ncaycchgrggdytaaa

SEQ ID NO: 7565 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (7)..(7): base is a locked nucleic acid
  modified_base (8)..(8): base is a locked nucleic acid
  modified_base (9)..(9): base is a locked nucleic acid
ncaycchgrggdytaaa

SEQ ID NO: 7566 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (2)..(2): base is a locked nucleic acid
  modified_base (8)..(8): base is a locked nucleic acid
  modified_base (9)..(9): base is a locked nucleic acid
ncaycchgrggdytaaa

SEQ ID NO: 7567 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (6)..(6): base is a locked nucleic acid
  modified_base (8)..(8): base is a locked nucleic acid
  modified_base (9)..(9): base is a locked nucleic acid
ncaycchgrggdytaaa

SEQ ID NO: 7568 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
ncaycchgrggdytaaa

SEQ ID NO: 7569 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (11)..(11): base is a locked nucleic acid
ncaycchgrggdyta

SEQ ID NO: 7570 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (13)..(13): base is a locked nucleic acid
ncaycchgrggdyta

SEQ ID NO: 7571 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (15)..(15): base is a locked nucleic acid
ncaycchgrggdyta

SEQ ID NO: 7572 - DNA, 16 bp, Artificial Sequence
  Oligonucleotide probe
  misc_binding (1)..(16): Hybridization probe for the specific detection of mutant HIV-1 at codon 98 of the reverse transcriptase gene.
  misc_feature (1)..(1): n is a, c, g, or t
ncaycchgrggdytaa

SEQ ID NO: 7573 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (2)..(2): base is a locked nucleic acid
ncaycchgrggdyta

SEQ ID NO: 7574 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (3)..(3): base is a locked nucleic acid
ncaycchgrggdyta

SEQ ID NO: 7575 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (4)..(4): base is a locked nucleic acid
ncaycchgrggdyta

SEQ ID NO: 7576 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  modified_base (1)..(1): base is a locked nucleic acid
  misc_feature (1)..(1): n is a, c, g, or t
ncaycchgrggdyta

SEQ ID NO: 7577 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (11)..(11): base is a locked nucleic acid
ncaycchgrggdyta

SEQ ID NO: 7578 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (13)..(13): base is a locked nucleic acid
ncaycchgrggdyta

SEQ ID NO: 7579 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (10)..(10): base is a locked nucleic acid
ncaycchgrggdyta

SEQ ID NO: 7580 - DNA, 16 bp, Artificial Sequence
  Oligonucleotide probe
  misc_binding (1)..(16): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
ncaycchgrggdytaa

SEQ ID NO: 7581 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (5)..(5): base is a locked nucleic acid
  modified_base (8)..(8): base is a locked nucleic acid
  modified_base (9)..(9): base is a locked nucleic acid
ncaycchgrggdyta

SEQ ID NO: 7582 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (7)..(7): base is a locked nucleic acid
  modified_base (8)..(8): base is a locked nucleic acid
  modified_base (9)..(9): base is a locked nucleic acid
ncaycchgrggdyta

SEQ ID NO: 7583 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (2)..(2): base is a locked nucleic acid
  modified_base (8)..(8): base is a locked nucleic acid
  modified_base (9)..(9): base is a locked nucleic acid
ncaycchgrggdyta

SEQ ID NO: 7584 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (6)..(6): base is a locked nucleic acid
  modified_base (8)..(8): base is a locked nucleic acid
  modified_base (9)..(9): base is a locked nucleic acid
ncaycchgrggdyta

SEQ ID NO: 7585 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
ncaycchgrggdyta

SEQ ID NO: 7586 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (11)..(11): base is a locked nucleic acid
ncaycchgrggdy

SEQ ID NO: 7587 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (13)..(13): base is a locked nucleic acid
ncaycchgrggdy

SEQ ID NO: 7588 - DNA, 14 bp, Artificial Sequence
  Oligonucleotide probe
  misc_binding (1)..(14): Hybridization probe for the specific detection of mutant HIV-1 at codon 98 of the reverse transcriptase gene.
  misc_feature (1)..(1): n is a, c, g, or t
ncaycchgrggdyt

SEQ ID NO: 7589 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (2)..(2): base is a locked nucleic acid
ncaycchgrggdy

SEQ ID NO: 7590 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (3)..(3): base is a locked nucleic acid
ncaycchgrggdy

SEQ ID NO: 7591 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (4)..(4): base is a locked nucleic acid
ncaycchgrggdy

SEQ ID NO: 7592 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  modified_base (1)..(1): base is a locked nucleic acid
  misc_feature (1)..(1): n is a, c, g, or t
ncaycchgrggdy

SEQ ID NO: 7593 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (11)..(11): base is a locked nucleic acid
ncaycchgrggdy

SEQ ID NO: 7594 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (13)..(13): base is a locked nucleic acid
ncaycchgrggdy

SEQ ID NO: 7595 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
  modified_base (10)..(10): base is a locked nucleic acid
ncaycchgrggdy

SEQ ID NO: 7596 - DNA, 14 bp, Artificial Sequence
  Oligonucleotide probe
  misc_binding (1)..(14): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
ncaycchgrggdyt

SEQ ID NO: 7597 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (5)..(5): base is a locked nucleic acid
  modified_base (8)..(8): base is a locked nucleic acid
  modified_base (9)..(9): base is a locked nucleic acid
ncaycchgrggdy

SEQ ID NO: 7598 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (7)..(7): base is a locked nucleic acid
  modified_base (8)..(8): base is a locked nucleic acid
  modified_base (9)..(9): base is a locked nucleic acid
ncaycchgrggdy

SEQ ID NO: 7599 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (2)..(2): base is a locked nucleic acid
  modified_base (8)..(8): base is a locked nucleic acid
  modified_base (9)..(9): base is a locked nucleic acid
ncaycchgrggdy

SEQ ID NO: 7600 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (6)..(6): base is a locked nucleic acid
  modified_base (8)..(8): base is a locked nucleic acid
  modified_base (9)..(9): base is a locked nucleic acid
ncaycchgrggdy

SEQ ID NO: 7601 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
  modified_base (8)..(8): base is a locked nucleic acid
  modified_base (9)..(9): base is a locked nucleic acid
ncaycchgrggdy

SEQ ID NO: 7602 - DNA, 15 bp, Artificial Sequence
  Oligonucleotide probe
  misc_binding (1)..(15): Hybridization probe for the specific detection of mutant HIV-1 at codon 98 of the reverse transcriptase gene.
catccagghgggtta

SEQ ID NO: 7603 - DNA, 18 bp, Artificial Sequence
  Oligonucleotide probe
  misc_binding (1)..(18): Hybridization probe for the specific detection of mutant HIV-1 at codon 98 of the reverse transcriptase gene.
  misc_feature (2)..(2): n is a, c, g, or t
cncaycchgrggdytaaa

SEQ ID NO: 7604 - DNA, 17 bp, Artificial Sequence
  Oligonucleotide probe
  misc_binding (1)..(17): Hybridization probe for the specific detection of mutant HIV-1 at codon 98 of the reverse transcriptase gene.
  misc_feature (1)..(1): n is a, c, g, or t
ncaycchgrggdytaaa

SEQ ID NO: 7605 - DNA, 15 bp, Artificial Sequence
  Oligonucleotide probe
  misc_binding (1)..(15): Hybridization probe for the specific detection of mutant HIV-1 at codon 98 of the reverse transcriptase gene.
  misc_feature (1)..(1): n is a, c, g, or t
ncaycchgrggdyta

SEQ ID NO: 7606 - DNA, 13 bp, Artificial Sequence
  Oligonucleotide probe
  misc_binding (1)..(13): Hybridization probe for the specific detection of mutant HIV-1 at codon 98 of the reverse transcriptase gene.
  misc_feature (1)..(1): n is a, c, g, or t
ncaycchgrggdy

SEQ ID NO: 7607 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (15)..(15): base is a locked nucleic acid
cchgcrggdtaaaaaaga

SEQ ID NO: 7608 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (13)..(13): base is a locked nucleic acid
cchgcrggdtaaaaaaga

SEQ ID NO: 7609 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (14)..(14): base is a locked nucleic acid
cchgcrggdtaaaaaaga

SEQ ID NO: 7610 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (18)..(18): base is a locked nucleic acid
cchgcrggdtaaaaaaga

SEQ ID NO: 7611 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (4)..(4): base is a locked nucleic acid
cchgcrggdtaaaaaaga

SEQ ID NO: 7612 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (9)..(9): base is a locked nucleic acid
cchgcrggdtaaaaaaga

SEQ ID NO: 7613 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (3)..(3): base is a locked nucleic acid
cchgcrggdtaaaaaaga

SEQ ID NO: 7614 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (2)..(2): base is a locked nucleic acid
cchgcrggdtaaaaaaga

SEQ ID NO: 7615 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (9)..(9): base is a locked nucleic acid
  modified_base (10)..(10): base is a locked nucleic acid
  modified_base (18)..(18): base is a locked nucleic acid
cchgcrggdtaaaaaaga

SEQ ID NO: 7616 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (9)..(9): base is a locked nucleic acid
  modified_base (10)..(10): base is a locked nucleic acid
  modified_base (14)..(14): base is a locked nucleic acid
cchgcrggdtaaaaaaga

SEQ ID NO: 7617 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (9)..(9): base is a locked nucleic acid
  modified_base (10)..(10): base is a locked nucleic acid
  modified_base (11)..(11): base is a locked nucleic acid
cchgcrggdtaaaaaaga

SEQ ID NO: 7618 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (9)..(9): base is a locked nucleic acid
  modified_base (10)..(10): base is a locked nucleic acid
  modified_base (15)..(15): base is a locked nucleic acid
cchgcrggdtaaaaaaga

SEQ ID NO: 7619 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (6)..(6): base is a locked nucleic acid
  modified_base (9)..(9): base is a locked nucleic acid
  modified_base (10)..(10): base is a locked nucleic acid
cchgcrggdtaaaaaaga

SEQ ID NO: 7620 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (10)..(10): base is a locked nucleic acid
cchgcrggdtaaaaaaga

SEQ ID NO: 7621 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (4)..(4): base is a locked nucleic acid
  modified_base (9)..(9): base is a locked nucleic acid
  modified_base (10)..(10): base is a locked nucleic acid
cchgcrggdtaaaaaaga

SEQ ID NO: 7622 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (3)..(3): base is a locked nucleic acid
  modified_base (9)..(9): base is a locked nucleic acid
  modified_base (10)..(10): base is a locked nucleic acid
cchgcrggdtaaaaaaga

SEQ ID NO: 7623 - DNA, 18 bp, Artificial Sequence
  Oligonucleotide probe
  misc_binding (1)..(18): Hybridization probe for the specific detection of mutant HIV-1 at codon 100 of the reverse transcriptase gene.
  modified_base (9)..(9): base is a locked nucleic acid
  modified_base (10)..(10): base is a locked nucleic acid
cchgcrggdtaaaaaaga

SEQ ID NO: 7624 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (14)..(14): base is a locked nucleic acid
chgcrggdtaaaaaaga

SEQ ID NO: 7625 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (12)..(12): base is a locked nucleic acid
chgcrggdtaaaaaaga

SEQ ID NO: 7626 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (13)..(13): base is a locked nucleic acid
chgcrggdtaaaaaaga

SEQ ID NO: 7627 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (17)..(17): base is a locked nucleic acid
chgcrggdtaaaaaaga

SEQ ID NO: 7628 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (3)..(3): base is a locked nucleic acid
chgcrggdtaaaaaaga

SEQ ID NO: 7629 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (8)..(8): base is a locked nucleic acid
chgcrggdtaaaaaaga

SEQ ID NO: 7630 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (2)..(2): base is a locked nucleic acid
chgcrggdtaaaaaaga

SEQ ID NO: 7631 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (1)..(1): base is a locked nucleic acid
chgcrggdtaaaaaaga

SEQ ID NO: 7632 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (17)..(17): base is a locked nucleic acid
chgcrggdtaaaaaaga

SEQ ID NO: 7633 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (13)..(13): base is a locked nucleic acid
chgcrggdtaaaaaaga

SEQ ID NO: 7634 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (10)..(10): base is a locked nucleic acid
chgcrggdtaaaaaaga

SEQ ID NO: 7635 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (14)..(14): base is a locked nucleic acid
chgcrggdtaaaaaaga

SEQ ID NO: 7636 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (5)..(5): base is a locked nucleic acid
  modified_base (8)..(8): base is a locked nucleic acid
  modified_base (9)..(9): base is a locked nucleic acid
chgcrggdtaaaaaaga

SEQ ID NO: 7637 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (7)..(7): base is a locked nucleic acid
  modified_base (8)..(8): base is a locked nucleic acid
  modified_base (9)..(9): base is a locked nucleic acid
chgcrggdtaaaaaaga

SEQ ID NO: 7638 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (3)..(3): base is a locked nucleic acid
  modified_base (8)..(8): base is a locked nucleic acid
  modified_base (9)..(9): base is a locked nucleic acid
chgcrggdtaaaaaaga

SEQ ID NO: 7639 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (2)..(2): base is a locked nucleic acid
  modified_base (8)..(8): base is a locked nucleic acid
  modified_base (9)..(9): base is a locked nucleic acid
chgcrggdtaaaaaaga

SEQ ID NO: 7640 - DNA, 17 bp, Artificial Sequence
  Oligonucleotide probe
  misc_binding (1)..(17): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
chgcrggdtaaaaaaga

SEQ ID NO: 7641 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (14)..(14): base is a locked nucleic acid
chgcrggdtaaaaaa

SEQ ID NO: 7642 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (12)..(12): base is a locked nucleic acid
chgcrggdtaaaaaa

SEQ ID NO: 7643 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (13)..(13): base is a locked nucleic acid
chgcrggdtaaaaaa

SEQ ID NO: 7644 - DNA, 16 bp, Artificial Sequence
  Oligonucleotide probe
  misc_binding (1)..(16): Hybridization probe for the specific detection of mutant HIV-1 at codon 100 of the reverse transcriptase gene.
chgcrggdtaaaaaag

SEQ ID NO: 7645 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (3)..(3): base is a locked nucleic acid
chgcrggdtaaaaaa

SEQ ID NO: 7646 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (8)..(8): base is a locked nucleic acid
chgcrggdtaaaaaa

SEQ ID NO: 7647 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (2)..(2): base is a locked nucleic acid
chgcrggdtaaaaaa

SEQ ID NO: 7648 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (1)..(1): base is a locked nucleic acid
chgcrggdtaaaaaa

SEQ ID NO: 7649 - DNA, 16 bp, Artificial Sequence
  Oligonucleotide probe
  misc_binding (1)..(16): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
chgcrggdtaaaaaag

SEQ ID NO: 7650 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (13)..(13): base is a locked nucleic acid
chgcrggdtaaaaaa

SEQ ID NO: 7651 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (10)..(10): base is a locked nucleic acid
chgcrggdtaaaaaa

SEQ ID NO: 7652 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (14)..(14): base is a locked nucleic acid
chgcrggdtaaaaaa

SEQ ID NO: 7653 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (5)..(5): base is a locked nucleic acid
  modified_base (8)..(8): base is a locked nucleic acid
  modified_base (9)..(9): base is a locked nucleic acid
chgcrggdtaaaaaa

SEQ ID NO: 7654 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (7)..(7): base is a locked nucleic acid
  modified_base (8)..(8): base is a locked nucleic acid
  modified_base (9)..(9): base is a locked nucleic acid
chgcrggdtaaaaaa

SEQ ID NO: 7655 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (3)..(3): base is a locked nucleic acid
  modified_base (8)..(8): base is a locked nucleic acid
  modified_base (9)..(9): base is a locked nucleic acid
chgcrggdtaaaaaa

SEQ ID NO: 7656 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (2)..(2): base is a locked nucleic acid
  modified_base (8)..(8): base is a locked nucleic acid
  modified_base (9)..(9): base is a locked nucleic acid
chgcrggdtaaaaaa

SEQ ID NO: 7657 - DNA, 15 bp, Artificial Sequence
  Oligonucleotide probe
  misc_binding (1)..(15): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
chgcrggdtaaaaaa

SEQ ID NO: 7658 - DNA, 13 bp, Artificial Sequence
  Oligonucleotide probe
  misc_binding (1)..(13): Hybridization probe for the specific detection of mutant HIV-1 at codon 100 of the reverse transcriptase gene.
chgcrggdtaaaa

SEQ ID NO: 7659 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (12)..(12): base is a locked nucleic acid
chgcrggdtaaaa

SEQ ID NO: 7660 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (13)..(13): base is a locked nucleic acid
chgcrggdtaaaa

SEQ ID NO: 7661 - DNA, 14 bp, Artificial Sequence
  Oligonucleotide probe
  misc_binding (1)..(14): Hybridization probe for the specific detection of mutant HIV-1 at codon 100 of the reverse transcriptase gene.
chgcrggdtaaaaa

SEQ ID NO: 7662 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (3)..(3): base is a locked nucleic acid
chgcrggdtaaaa

SEQ ID NO: 7663 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (8)..(8): base is a locked nucleic acid
chgcrggdtaaaa

SEQ ID NO: 7664 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (2)..(2): base is a locked nucleic acid
chgcrggdtaaaa

SEQ ID NO: 7665 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (1)..(1): base is a locked nucleic acid
chgcrggdtaaaa

SEQ ID NO: 7666 - DNA, 14 bp, Artificial Sequence
  Oligonucleotide probe
  misc_binding (1)..(14): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
chgcrggdtaaaaa

SEQ ID NO: 7667 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (13)..(13): base is a locked nucleic acid
chgcrggdtaaaa

SEQ ID NO: 7668 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
  modified_base (10)..(10): base is a locked nucleic acid
chgcrggdtaaaa

SEQ ID NO: 7669 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
chgcrggdtaaaa

SEQ ID NO: 7670 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (5)..(5): base is a locked nucleic acid
  modified_base (8)..(8): base is a locked nucleic acid
  modified_base (9)..(9): base is a locked nucleic acid
chgcrggdtaaaa

SEQ ID NO: 7671 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (7)..(7): base is a locked nucleic acid
  modified_base (8)..(8): base is a locked nucleic acid
  modified_base (9)..(9): base is a locked nucleic acid
chgcrggdtaaaa

SEQ ID NO: 7672 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (3)..(3): base is a locked nucleic acid
  modified_base (8)..(8): base is a locked nucleic acid
  modified_base (9)..(9): base is a locked nucleic acid
chgcrggdtaaaa

SEQ ID NO: 7673 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (2)..(2): base is a locked nucleic acid
  modified_base (8)..(8): base is a locked nucleic acid
  modified_base (9)..(9): base is a locked nucleic acid
chgcrggdtaaaa

SEQ ID NO: 7674 - DNA, 13 bp, Artificial Sequence
  Oligonucleotide probe
  misc_binding (1)..(13): Hybridization probe for the specific detection of mutant HIV-1 at codon 100 of the reverse transcriptase gene.
  modified_base (8)..(8): base is a locked nucleic acid
  modified_base (9)..(9): base is a locked nucleic acid
chgcrggdtaaaa

SEQ ID NO: 7675 - DNA, 15 bp, Artificial Sequence
  Oligonucleotide probe
  misc_binding (1)..(15): Hybridization probe for the specific detection of mutant HIV-1 at codon 100 of the reverse transcriptase gene.
agcagggataaaaaa

SEQ ID NO: 7676 - DNA, 18 bp, Artificial Sequence
  Oligonucleotide probe
  misc_binding (1)..(18): Hybridization probe for the specific detection of mutant HIV-1 at codon 100 of the reverse transcriptase gene.
cchgcrggdtaaaaaaga

SEQ ID NO: 7677 - DNA, 17 bp, Artificial Sequence
  Oligonucleotide probe
  misc_binding (1)..(17): Hybridization probe for the specific detection of mutant HIV-1 at codon 100 of the reverse transcriptase gene.
chgcrggdtaaaaaaga

SEQ ID NO: 7678 - DNA, 15 bp, Artificial Sequence
  Oligonucleotide probe
  misc_binding (1)..(15): Hybridization probe for the specific detection of mutant HIV-1 at codon 100 of the reverse transcriptase gene.
chgcrggdtaaaaaa

SEQ ID NO: 7679 - DNA, 13 bp, Artificial Sequence
  Oligonucleotide probe
  misc_binding (1)..(13): Hybridization probe for the specific detection of mutant HIV-1 at codon 100 of the reverse transcriptase gene.
chgcrggdtaaaa

SEQ ID NO: 7680 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (14)..(14): base is a locked nucleic acid
gcrggdytaaaaagaama

SEQ ID NO: 7681 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (11)..(11): base is a locked nucleic acid
gcrggdytaaaaagaama

SEQ ID NO: 7682 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (16)..(16): base is a locked nucleic acid
gcrggdytaaaaagaama

SEQ ID NO: 7683 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (15)..(15): base is a locked nucleic acid
gcrggdytaaaaagaama

SEQ ID NO: 7684 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (9)..(9): base is a locked nucleic acid
gcrggdytaaaaagaama

SEQ ID NO: 7685 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (6)..(6): base is a locked nucleic acid
gcrggdytaaaaagaama

SEQ ID NO: 7686 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (3)..(3): base is a locked nucleic acid
gcrggdytaaaaagaama

SEQ ID NO: 7687 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (5)..(5): base is a locked nucleic acid
gcrggdytaaaaagaama

SEQ ID NO: 7688 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (9)..(9): base is a locked nucleic acid
  modified_base (10)..(10): base is a locked nucleic acid
  modified_base (11)..(11): base is a locked nucleic acid
gcrggdytaaaaagaama

SEQ ID NO: 7689 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (9)..(9): base is a locked nucleic acid
  modified_base (10)..(10): base is a locked nucleic acid
  modified_base (18)..(18): base is a locked nucleic acid
gcrggdytaaaaagaama

SEQ ID NO: 7690 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (9)..(9): base is a locked nucleic acid
  modified_base (10)..(10): base is a locked nucleic acid
  modified_base (13)..(13): base is a locked nucleic acid
gcrggdytaaaaagaama

SEQ ID NO: 7691 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (9)..(9): base is a locked nucleic acid
  modified_base (10)..(10): base is a locked nucleic acid
  modified_base (17)..(17): base is a locked nucleic acid
gcrggdytaaaaagaama

SEQ ID NO: 7692 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (6)..(6): base is a locked nucleic acid
  modified_base (9)..(9): base is a locked nucleic acid
  modified_base (10)..(10): base is a locked nucleic acid
gcrggdytaaaaagaama

SEQ ID NO: 7693 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (2)..(2): base is a locked nucleic acid
  modified_base (9)..(9): base is a locked nucleic acid
  modified_base (10)..(10): base is a locked nucleic acid
gcrggdytaaaaagaama

SEQ ID NO: 7694 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (7)..(7): base is a locked nucleic acid
  modified_base (9)..(9): base is a locked nucleic acid
  modified_base (10)..(10): base is a locked nucleic acid
gcrggdytaaaaagaama

SEQ ID NO: 7695 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (3)..(3): base is a locked nucleic acid
  modified_base (9)..(9): base is a locked nucleic acid
  modified_base (10)..(10): base is a locked nucleic acid
gcrggdytaaaaagaama

SEQ ID NO: 7696 - DNA, 18 bp, Artificial Sequence
  Oligonucleotide probe
  misc_binding (1)..(18): Hybridization probe for the specific detection of mutant HIV-1 at codon 101 of the reverse transcriptase gene.
  modified_base (9)..(9): base is a locked nucleic acid
  modified_base (10)..(10): base is a locked nucleic acid
gcrggdytaaaaagaama

SEQ ID NO: 7697 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (13)..(13): base is a locked nucleic acid
crggdytaaaaagaama

SEQ ID NO: 7698 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (10)..(10): base is a locked nucleic acid
crggdytaaaaagaama

SEQ ID NO: 7699 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (15)..(15): base is a locked nucleic acid
crggdytaaaaagaama

SEQ ID NO: 7700 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (14)..(14): base is a locked nucleic acid
crggdytaaaaagaama

SEQ ID NO: 7701 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (8)..(8): base is a locked nucleic acid
crggdytaaaaagaama

SEQ ID NO: 7702 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (5)..(5): base is a locked nucleic acid
crggdytaaaaagaama

SEQ ID NO: 7703 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (2)..(2): base is a locked nucleic acid
crggdytaaaaagaama

SEQ ID NO: 7704 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (4)..(4): base is a locked nucleic acid
crggdytaaaaagaama

SEQ ID NO: 7705 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (10)..(10): base is a locked nucleic acid
crggdytaaaaagaama

SEQ ID NO: 7706 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (17)..(17): base is a locked nucleic acid
crggdytaaaaagaama

SEQ ID NO: 7707 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (12)..(12): base is a locked nucleic acid
crggdytaaaaagaama

SEQ ID NO: 7708 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (16)..(16): base is a locked nucleic acid
crggdytaaaaagaama

SEQ ID NO: 7709 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (5)..(5): base is a locked nucleic acid
  modified_base (8)..(8): base is a locked nucleic acid
  modified_base (9)..(9): base is a locked nucleic acid
crggdytaaaaagaama

SEQ ID NO: 7710 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (1)..(1): base is a locked nucleic acid
  modified_base (8)..(8): base is a locked nucleic acid
  modified_base (9)..(9): base is a locked nucleic acid
crggdytaaaaagaama

SEQ ID NO: 7711 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (6)..(6): base is a locked nucleic acid
  modified_base (8)..(8): base is a locked nucleic acid
  modified_base (9)..(9): base is a locked nucleic acid
crggdytaaaaagaama

SEQ ID NO: 7712 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (2)..(2): base is a locked nucleic acid
  modified_base (8)..(8): base is a locked nucleic acid
  modified_base (9)..(9): base is a locked nucleic acid
crggdytaaaaagaama

SEQ ID NO: 7713 - DNA, 17 bp, Artificial Sequence
  Oligonucleotide probe
  misc_binding (1)..(17): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
crggdytaaaaagaama

SEQ ID NO: 7714 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (13)..(13): base is a locked nucleic acid
crggdytaaaaagaa

SEQ ID NO: 7715 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (10)..(10): base is a locked nucleic acid
crggdytaaaaagaa

SEQ ID NO: 7716 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (15)..(15): base is a locked nucleic acid
crggdytaaaaagaa

SEQ ID NO: 7717 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (14)..(14): base is a locked nucleic acid
crggdytaaaaagaa

SEQ ID NO: 7718 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (8)..(8): base is a locked nucleic acid
crggdytaaaaagaa

SEQ ID NO: 7719 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (5)..(5): base is a locked nucleic acid
crggdytaaaaagaa

SEQ ID NO: 7720 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (2)..(2): base is a locked nucleic acid
crggdytaaaaagaa

SEQ ID NO: 7721 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (4)..(4): base is a locked nucleic acid
crggdytaaaaagaa

SEQ ID NO: 7722 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (10)..(10): base is a locked nucleic acid
crggdytaaaaagaa

SEQ ID NO: 7723 - DNA, 16 bp, Artificial Sequence
  Oligonucleotide probe
  misc_binding (1)..(16): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
crggdytaaaaagaam

SEQ ID NO: 7724 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (12)..(12): base is a locked nucleic acid
crggdytaaaaagaa

SEQ ID NO: 7725 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
crggdytaaaaagaa

SEQ ID NO: 7726 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (5)..(5): base is a locked nucleic acid
  modified_base (8)..(8): base is a locked nucleic acid
  modified_base (9)..(9): base is a locked nucleic acid
crggdytaaaaagaa

SEQ ID NO: 7727 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (1)..(1): base is a locked nucleic acid
  modified_base (8)..(8): base is a locked nucleic acid
  modified_base (9)..(9): base is a locked nucleic acid
crggdytaaaaagaa

SEQ ID NO: 7728 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (6)..(6): base is a locked nucleic acid
  modified_base (8)..(8): base is a locked nucleic acid
  modified_base (9)..(9): base is a locked nucleic acid
crggdytaaaaagaa

SEQ ID NO: 7729 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (2)..(2): base is a locked nucleic acid
  modified_base (8)..(8): base is a locked nucleic acid
  modified_base (9)..(9): base is a locked nucleic acid
crggdytaaaaagaa

SEQ ID NO: 7730 - DNA, 15 bp, Artificial Sequence
  Oligonucleotide probe
  misc_binding (1)..(15): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
crggdytaaaaagaa

SEQ ID NO: 7731 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (13)..(13): base is a locked nucleic acid
crggdytaaaaag

SEQ ID NO: 7732 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (10)..(10): base is a locked nucleic acid
crggdytaaaaag

SEQ ID NO: 7733 - DNA, 14 bp, Artificial Sequence
  Oligonucleotide probe
  misc_binding (1)..(14): Hybridization probe for the specific detection of mutant HIV-1 at codon 101 of the reverse transcriptase gene.
crggdytaaaaaga

SEQ ID NO: 7734 - DNA, 13 bp, Artificial Sequence
  Oligonucleotide probe
  misc_binding (1)..(13): Hybridization probe for the specific detection of mutant HIV-1 at codon 101 of the reverse transcriptase gene.
crggdytaaaaag

SEQ ID NO: 7735 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (8)..(8): base is a locked nucleic acid
crggdytaaaaag

SEQ ID NO: 7736 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (5)..(5): base is a locked nucleic acid
crggdytaaaaag

SEQ ID NO: 7737 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (2)..(2): base is a locked nucleic acid
crggdytaaaaag

SEQ ID NO: 7738 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (4)..(4): base is a locked nucleic acid
crggdytaaaaag

SEQ ID NO: 7739 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (10)..(10): base is a locked nucleic acid
crggdytaaaaag

SEQ ID NO: 7740 - DNA, 14 bp, Artificial Sequence
  Oligonucleotide probe
  misc_binding (1)..(14): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
crggdytaaaaaga

SEQ ID NO: 7741 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
  modified_base (12)..(12): base is a locked nucleic acid
crggdytaaaaag

SEQ ID NO: 7742 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (5)..(5): base is a locked nucleic acid
  modified_base (8)..(8): base is a locked nucleic acid
  modified_base (9)..(9): base is a locked nucleic acid
crggdytaaaaag

SEQ ID NO: 7743 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (1)..(1): base is a locked nucleic acid
  modified_base (8)..(8): base is a locked nucleic acid
  modified_base (9)..(9): base is a locked nucleic acid
crggdytaaaaag

SEQ ID NO: 7744 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (6)..(6): base is a locked nucleic acid
  modified_base (8)..(8): base is a locked nucleic acid
  modified_base (9)..(9): base is a locked nucleic acid
crggdytaaaaag

SEQ ID NO: 7745 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (2)..(2): base is a locked nucleic acid
  modified_base (8)..(8): base is a locked nucleic acid
  modified_base (9)..(9): base is a locked nucleic acid
crggdytaaaaag

SEQ ID NO: 7746 - DNA, 13 bp, Artificial Sequence
  Oligonucleotide probe
  misc_binding (1)..(13): Hybridization probe for the specific detection of mutant HIV-1 at codon 101 of the reverse transcriptase gene.
  modified_base (8)..(8): base is a locked nucleic acid
  modified_base (9)..(9): base is a locked nucleic acid
crggdytaaaaag

SEQ ID NO: 7747 - DNA, 15 bp, Artificial Sequence
  Oligonucleotide probe
  misc_binding (1)..(15): Hybridization probe for the specific detection of mutant HIV-1 at codon 101 of the reverse transcriptase gene.
tttcttyggtaaccc

SEQ ID NO: 7748 - DNA, 15 bp, Artificial Sequence
  Oligonucleotide probe
  misc_binding (1)..(15): Hybridization probe for the specific detection of mutant HIV-1 at codon 101 of the reverse transcriptase gene.
tttcttytctaaccc

SEQ ID NO: 7749 - DNA, 15 bp, Artificial Sequence
  Oligonucleotide probe
  misc_binding (1)..(15): Hybridization probe for the specific detection of mutant HIV-1 at codon 101 of the reverse transcriptase gene.
tttcttrtgtaaccc

SEQ ID NO: 7750 - DNA, 18 bp, Artificial Sequence
  Oligonucleotide probe
  misc_binding (1)..(18): Hybridization probe for the specific detection of mutant HIV-1 at codon 101 of the reverse transcriptase gene.
gcrggdytaaaaagaama

SEQ ID NO: 7751 - DNA, 17 bp, Artificial Sequence
  Oligonucleotide probe
  misc_binding (1)..(17): Hybridization probe for the specific detection of mutant HIV-1 at codon 101 of the reverse transcriptase gene.
crggdytaaaaagaama

SEQ ID NO: 7752 - DNA, 15 bp, Artificial Sequence
  Oligonucleotide probe
  misc_binding (1)..(15): Hybridization probe for the specific detection of mutant HIV-1 at codon 101 of the reverse transcriptase gene.
crggdytaaaaagaa

SEQ ID NO: 7753 - DNA, 16 bp, Artificial Sequence
  Oligonucleotide probe
  misc_binding (1)..(16): Hybridization probe for the specific detection of mutant HIV-1 at codon 101 of the reverse transcriptase gene.
crggdytaaaaagaam

SEQ ID NO: 7754 - DNA, 13 bp, Artificial Sequence
  Oligonucleotide probe
  misc_binding (1)..(13): Hybridization probe for the specific detection of mutant HIV-1 at codon 101 of the reverse transcriptase gene.
crggdytaaaaag

SEQ ID NO: 7755 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (14)..(14): base is a locked nucleic acid
aaaaaagaaaaatcagtr

SEQ ID NO: 7756 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (15)..(15): base is a locked nucleic acid
aaaaaagaaaaatcagtr

SEQ ID NO: 7757 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (10)..(10): base is a locked nucleic acid
aaaaaagaaaaatcagtr

SEQ ID NO: 7758 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (16)..(16): base is a locked nucleic acid
aaaaaagaaaaatcagtr

SEQ ID NO: 7759 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (4)..(4): base is a locked nucleic acid
aaaaaagaaaaatcagtr

SEQ ID NO: 7760 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (5)..(5): base is a locked nucleic acid
aaaaaagaaaaatcagtr

SEQ ID NO: 7761 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (8)..(8): base is a locked nucleic acid
aaaaaagaaaaatcagtr

SEQ ID NO: 7762 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (6)..(6): base is a locked nucleic acid
aaaaaagaaaaatcagtr

SEQ ID NO: 7763 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (9)..(9): base is a locked nucleic acid
  modified_base (10)..(10): base is a locked nucleic acid
  modified_base (16)..(16): base is a locked nucleic acid
aaaaaagaaaaatcagtr

SEQ ID NO: 7764 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (9)..(9): base is a locked nucleic acid
  modified_base (10)..(10): base is a locked nucleic acid
  modified_base (14)..(14): base is a locked nucleic acid
aaaaaagaaaaatcagtr

SEQ ID NO: 7765 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (9)..(9): base is a locked nucleic acid
  modified_base (10)..(10): base is a locked nucleic acid
  modified_base (11)..(11): base is a locked nucleic acid
aaaaaagaaaaatcagtr

SEQ ID NO: 7766 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (9)..(9): base is a locked nucleic acid
  modified_base (10)..(10): base is a locked nucleic acid
  modified_base (17)..(17): base is a locked nucleic acid
aaaaaagaaaaatcagtr

SEQ ID NO: 7767 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (6)..(6): base is a locked nucleic acid
  modified_base (9)..(9): base is a locked nucleic acid
  modified_base (10)..(10): base is a locked nucleic acid
aaaaaagaaaaatcagtr

SEQ ID NO: 7768 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (3)..(3): base is a locked nucleic acid
  modified_base (9)..(9): base is a locked nucleic acid
  modified_base (10)..(10): base is a locked nucleic acid
aaaaaagaaaaatcagtr

SEQ ID NO: 7769 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (2)..(2): base is a locked nucleic acid
  modified_base (9)..(9): base is a locked nucleic acid
  modified_base (10)..(10): base is a locked nucleic acid
aaaaaagaaaaatcagtr

SEQ ID NO: 7770 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (5)..(5): base is a locked nucleic acid
  modified_base (9)..(9): base is a locked nucleic acid
  modified_base (10)..(10): base is a locked nucleic acid
aaaaaagaaaaatcagtr

SEQ ID NO: 7771 - DNA, 18 bp, Artificial Sequence
  Oligonucleotide probe
  misc_binding (1)..(18): Hybridization probe for the specific detection of mutant HIV-1 at codon 103 of the reverse transcriptase gene.
  modified_base (9)..(9): base is a locked nucleic acid
  modified_base (10)..(10): base is a locked nucleic acid
aaaaaagaaaaatcagtr

SEQ ID NO: 7772 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (13)..(13): base is a locked nucleic acid
aaaaagaaaaatcagtr

SEQ ID NO: 7773 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (14)..(14): base is a locked nucleic acid
aaaaagaaaaatcagtr

SEQ ID NO: 7774 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (9)..(9): base is a locked nucleic acid
aaaaagaaaaatcagtr

SEQ ID NO: 7775 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (15)..(15): base is a locked nucleic acid
aaaaagaaaaatcagtr

SEQ ID NO: 7776 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (3)..(3): base is a locked nucleic acid
aaaaagaaaaatcagtr

SEQ ID NO: 7777 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (4)..(4): base is a locked nucleic acid
aaaaagaaaaatcagtr

SEQ ID NO: 7778 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (7)..(7): base is a locked nucleic acid
aaaaagaaaaatcagtr

SEQ ID NO: 7779 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (5)..(5): base is a locked nucleic acid
aaaaagaaaaatcagtr

SEQ ID NO: 7780 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (15)..(15): base is a locked nucleic acid
aaaaagaaaaatcagtr

SEQ ID NO: 7781 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (13)..(13): base is a locked nucleic acid
aaaaagaaaaatcagtr

SEQ ID NO: 7782 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (10)..(10): base is a locked nucleic acid
aaaaagaaaaatcagtr

SEQ ID NO: 7783 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (16)..(16): base is a locked nucleic acid
aaaaagaaaaatcagtr

SEQ ID NO: 7784 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (5)..(5): base is a locked nucleic acid
  modified_base (8)..(8): base is a locked nucleic acid
  modified_base (9)..(9): base is a locked nucleic acid
aaaaagaaaaatcagtr

SEQ ID NO: 7785 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (2)..(2): base is a locked nucleic acid
  modified_base (8)..(8): base is a locked nucleic acid
  modified_base (9)..(9): base is a locked nucleic acid
aaaaagaaaaatcagtr

SEQ ID NO: 7786 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (1)..(1): base is a locked nucleic acid
  modified_base (8)..(8): base is a locked nucleic acid
  modified_base (9)..(9): base is a locked nucleic acid
aaaaagaaaaatcagtr

SEQ ID NO: 7787 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (4)..(4): base is a locked nucleic acid
  modified_base (8)..(8): base is a locked nucleic acid
  modified_base (9)..(9): base is a locked nucleic acid
aaaaagaaaaatcagtr

SEQ ID NO: 7788 - DNA, 17 bp, Artificial Sequence
  Oligonucleotide probe
  misc_binding (1)..(17): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
aaaaagaaaaatcagtr

SEQ ID NO: 7789 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (13)..(13): base is a locked nucleic acid
aaaaagaaaaatcag

SEQ ID NO: 7790 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (14)..(14): base is a locked nucleic acid
aaaaagaaaaatcag

SEQ ID NO: 7791 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (9)..(9): base is a locked nucleic acid
aaaaagaaaaatcag

SEQ ID NO: 7792 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (15)..(15): base is a locked nucleic acid
aaaaagaaaaatcag

SEQ ID NO: 7793 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (3)..(3): base is a locked nucleic acid
aaaaagaaaaatcag

SEQ ID NO: 7794 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (4)..(4): base is a locked nucleic acid
aaaaagaaaaatcag

SEQ ID NO: 7795 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (7)..(7): base is a locked nucleic acid
aaaaagaaaaatcag

SEQ ID NO: 7796 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (5)..(5): base is a locked nucleic acid
aaaaagaaaaatcag

SEQ ID NO: 7797 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (15)..(15): base is a locked nucleic acid
aaaaagaaaaatcag

SEQ ID NO: 7798 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (13)..(13): base is a locked nucleic acid
aaaaagaaaaatcag

SEQ ID NO: 7799 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (10)..(10): base is a locked nucleic acid
aaaaagaaaaatcag

SEQ ID NO: 7800 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
aaaaagaaaaatcag

SEQ ID NO: 7801 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (5)..(5): base is a locked nucleic acid
  modified_base (8)..(8): base is a locked nucleic acid
  modified_base (9)..(9): base is a locked nucleic acid
aaaaagaaaaatcag

SEQ ID NO: 7802 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (2)..(2): base is a locked nucleic acid
  modified_base (8)..(8): base is a locked nucleic acid
  modified_base (9)..(9): base is a locked nucleic acid
aaaaagaaaaatcag

SEQ ID NO: 7803 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (1)..(1): base is a locked nucleic acid
  modified_base (8)..(8): base is a locked nucleic acid
  modified_base (9)..(9): base is a locked nucleic acid
aaaaagaaaaatcag

SEQ ID NO: 7804 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (4)..(4): base is a locked nucleic acid
  modified_base (8)..(8): base is a locked nucleic acid
  modified_base (9)..(9): base is a locked nucleic acid
aaaaagaaaaatcag

SEQ ID NO: 7805 - DNA, 15 bp, Artificial Sequence
  Oligonucleotide probe
  misc_binding (1)..(15): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
aaaaagaaaaatcag

SEQ ID NO: 7806 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (13)..(13): base is a locked nucleic acid
aaaaagaaaaatc

SEQ ID NO: 7807 - DNA, 13 bp, Artificial Sequence
  Oligonucleotide probe
  misc_binding (1)..(13): Hybridization probe for the specific detection of mutant HIV-1 at codon 103 of the reverse transcriptase gene.
aaaaagaaaaatc

SEQ ID NO: 7808 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (9)..(9): base is a locked nucleic acid
aaaaagaaaaatc

SEQ ID NO: 7809 - DNA, 14 bp, Artificial Sequence
  Oligonucleotide probe
  misc_binding (1)..(14): Hybridization probe for the specific detection of mutant HIV-1 at codon 103 of the reverse transcriptase gene.
aaaaagaaaaatca

SEQ ID NO: 7810 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (3)..(3): base is a locked nucleic acid
aaaaagaaaaatc

SEQ ID NO: 7811 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (4)..(4): base is a locked nucleic acid
aaaaagaaaaatc

SEQ ID NO: 7812 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (7)..(7): base is a locked nucleic acid
aaaaagaaaaatc

SEQ ID NO: 7813 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (5)..(5): base is a locked nucleic acid
aaaaagaaaaatc

SEQ ID NO: 7814 - DNA, 14 bp, Artificial Sequence
  Oligonucleotide probe
  misc_binding (1)..(14): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
aaaaagaaaaatca

SEQ ID NO: 7815 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (13)..(13): base is a locked nucleic acid
aaaaagaaaaatc

SEQ ID NO: 7816 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
  modified_base (10)..(10): base is a locked nucleic acid
aaaaagaaaaatc

SEQ ID NO: 7817 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (5)..(5): base is a locked nucleic acid
  modified_base (8)..(8): base is a locked nucleic acid
  modified_base (9)..(9): base is a locked nucleic acid
aaaaagaaaaatc

SEQ ID NO: 7818 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (2)..(2): base is a locked nucleic acid
  modified_base (8)..(8): base is a locked nucleic acid
  modified_base (9)..(9): base is a locked nucleic acid
aaaaagaaaaatc

SEQ ID NO: 7819 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (1)..(1): base is a locked nucleic acid
  modified_base (8)..(8): base is a locked nucleic acid
  modified_base (9)..(9): base is a locked nucleic acid
aaaaagaaaaatc

SEQ ID NO: 7820 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (4)..(4): base is a locked nucleic acid
  modified_base (8)..(8): base is a locked nucleic acid
  modified_base (9)..(9): base is a locked nucleic acid
aaaaagaaaaatc

SEQ ID NO: 7821 - DNA, 13 bp, Artificial Sequence
  Oligonucleotide probe
  misc_binding (1)..(13): Hybridization probe for the specific detection of mutant HIV-1 at codon 103 of the reverse transcriptase gene.
  modified_base (8)..(8): base is a locked nucleic acid
  modified_base (9)..(9): base is a locked nucleic acid
aaaaagaaaaatc

SEQ ID NO: 7822 - DNA, 15 bp, Artificial Sequence
  Oligonucleotide probe
  misc_binding (1)..(15): Hybridization probe for the specific detection of mutant HIV-1 at codon 103 of the reverse transcriptase gene.
aaaagaayaaatcag

SEQ ID NO: 7823 - DNA, 15 bp, Artificial Sequence
  Oligonucleotide probe
  misc_binding (1)..(15): Hybridization probe for the specific detection of mutant HIV-1 at codon 103 of the reverse transcriptase gene.
aaaagagyaaatcag

SEQ ID NO: 7824 - DNA, 18 bp, Artificial Sequence
  Oligonucleotide probe
  misc_binding (1)..(18): Hybridization probe for the specific detection of mutant HIV-1 at codon 103 of the reverse transcriptase gene.
aaaaaagaaaaatcagtr

SEQ ID NO: 7825 - DNA, 17 bp, Artificial Sequence
  Oligonucleotide probe
  misc_binding (1)..(17): Hybridization probe for the specific detection of mutant HIV-1 at codon 103 of the reverse transcriptase gene.
aaaaagaaaaatcagtr

SEQ ID NO: 7826 - DNA, 15 bp, Artificial Sequence
  Oligonucleotide probe
  misc_binding (1)..(15): Hybridization probe for the specific detection of mutant HIV-1 at codon 103 of the reverse transcriptase gene.
aaaaagaaaaatcag

SEQ ID NO: 7827 - DNA, 13 bp, Artificial Sequence
  Oligonucleotide probe
  misc_binding (1)..(13): Hybridization probe for the specific detection of mutant HIV-1 at codon 103 of the reverse transcriptase gene.
aaaaagaaaaatc

SEQ ID NO: 7828 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (12)..(12): base is a locked nucleic acid
amaaatcagracagtryt

SEQ ID NO: 7829 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (18)..(18): base is a locked nucleic acid
amaaatcagracagtryt

SEQ ID NO: 7830 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (11)..(11): base is a locked nucleic acid
amaaatcagracagtryt

SEQ ID NO: 7831 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (17)..(17): base is a locked nucleic acid
amaaatcagracagtryt

SEQ ID NO: 7832 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (16)..(16): base is a locked nucleic acid
amaaatcagracagtryt

SEQ ID NO: 7833 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (14)..(14): base is a locked nucleic acid
amaaatcagracagtryt

SEQ ID NO: 7834 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (6)..(6): base is a locked nucleic acid
amaaatcagracagtryt

SEQ ID NO: 7835 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (5)..(5): base is a locked nucleic acid
amaaatcagracagtryt

SEQ ID NO: 7836 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (7)..(7): base is a locked nucleic acid
amaaatcagracagtryt

SEQ ID NO: 7837 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
amaaatcagracagtryt

SEQ ID NO: 7838 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (4)..(4): base is a locked nucleic acid
amaaatcagracagtryt

SEQ ID NO: 7839 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (3)..(3): base is a locked nucleic acid
amaaatcagracagtryt

SEQ ID NO: 7840 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (8)..(8): base is a locked nucleic acid
amaaatcagracagtryt

SEQ ID NO: 7841 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (2)..(2): base is a locked nucleic acid
amaaatcagracagtryt

SEQ ID NO: 7842 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
  modified_base (10)..(10): base is a locked nucleic acid
  modified_base (17)..(17): base is a locked nucleic acid
amaaatcagracagtryt

SEQ ID NO: 7843 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
  modified_base (10)..(10): base is a locked nucleic acid
  modified_base (18)..(18): base is a locked nucleic acid
amaaatcagracagtryt

SEQ ID NO: 7844 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
  modified_base (10)..(10): base is a locked nucleic acid
  modified_base (12)..(12): base is a locked nucleic acid
amaaatcagracagtryt

SEQ ID NO: 7845 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
  modified_base (10)..(10): base is a locked nucleic acid
  modified_base (14)..(14): base is a locked nucleic acid
amaaatcagracagtryt

SEQ ID NO: 7846 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
  modified_base (10)..(10): base is a locked nucleic acid
  modified_base (11)..(11): base is a locked nucleic acid
amaaatcagracagtryt

SEQ ID NO: 7847 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
  modified_base (10)..(10): base is a locked nucleic acid
  modified_base (16)..(16): base is a locked nucleic acid
amaaatcagracagtryt

SEQ ID NO: 7848 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (4)..(4): base is a locked nucleic acid
  modified_base (9)..(9): base is a locked nucleic acid
  modified_base (10)..(10): base is a locked nucleic acid
amaaatcagracagtryt

SEQ ID NO: 7849 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (5)..(5): base is a locked nucleic acid
  modified_base (9)..(9): base is a locked nucleic acid
  modified_base (10)..(10): base is a locked nucleic acid
amaaatcagracagtryt

SEQ ID NO: 7850 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (3)..(3): base is a locked nucleic acid
  modified_base (9)..(9): base is a locked nucleic acid
  modified_base (10)..(10): base is a locked nucleic acid
amaaatcagracagtryt

SEQ ID NO: 7851 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (7)..(7): base is a locked nucleic acid
  modified_base (9)..(9): base is a locked nucleic acid
  modified_base (10)..(10): base is a locked nucleic acid
amaaatcagracagtryt

SEQ ID NO: 7852 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (6)..(6): base is a locked nucleic acid
  modified_base (9)..(9): base is a locked nucleic acid
  modified_base (10)..(10): base is a locked nucleic acid
amaaatcagracagtryt

SEQ ID NO: 7853 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (2)..(2): base is a locked nucleic acid
  modified_base (9)..(9): base is a locked nucleic acid
  modified_base (10)..(10): base is a locked nucleic acid
amaaatcagracagtryt

SEQ ID NO: 7854 - DNA, 18 bp, Artificial Sequence
  Oligonucleotide probe
  misc_binding (1)..(18): Hybridization probe for the specific detection of mutant HIV-1 at codon 106 of the reverse transcriptase gene.
  modified_base (9)..(9): base is a locked nucleic acid
  modified_base (10)..(10): base is a locked nucleic acid
amaaatcagracagtryt

SEQ ID NO: 7855 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (11)..(11): base is a locked nucleic acid
maaatcagracagtryt

SEQ ID NO: 7856 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (17)..(17): base is a locked nucleic acid
maaatcagracagtryt

SEQ ID NO: 7857 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (10)..(10): base is a locked nucleic acid
maaatcagracagtryt

SEQ ID NO: 7858 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (16)..(16): base is a locked nucleic acid
maaatcagracagtryt

SEQ ID NO: 7859 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (15)..(15): base is a locked nucleic acid
maaatcagracagtryt

SEQ ID NO: 7860 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (13)..(13): base is a locked nucleic acid
maaatcagracagtryt

SEQ ID NO: 7861 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (5)..(5): base is a locked nucleic acid
maaatcagracagtryt

SEQ ID NO: 7862 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (4)..(4): base is a locked nucleic acid
maaatcagracagtryt

SEQ ID NO: 7863 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (6)..(6): base is a locked nucleic acid
maaatcagracagtryt

SEQ ID NO: 7864 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
maaatcagracagtryt

SEQ ID NO: 7865 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (3)..(3): base is a locked nucleic acid
maaatcagracagtryt

SEQ ID NO: 7866 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (2)..(2): base is a locked nucleic acid
maaatcagracagtryt

SEQ ID NO: 7867 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (7)..(7): base is a locked nucleic acid
maaatcagracagtryt

SEQ ID NO: 7868 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (1)..(1): base is a locked nucleic acid
maaatcagracagtryt

SEQ ID NO: 7869 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (16)..(16): base is a locked nucleic acid
maaatcagracagtryt

SEQ ID NO: 7870 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (17)..(17): base is a locked nucleic acid
maaatcagracagtryt

SEQ ID NO: 7871 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (11)..(11): base is a locked nucleic acid
maaatcagracagtryt

SEQ ID NO: 7872 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (13)..(13): base is a locked nucleic acid
maaatcagracagtryt

SEQ ID NO: 7873 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (10)..(10): base is a locked nucleic acid
maaatcagracagtryt

SEQ ID NO: 7874 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (15)..(15): base is a locked nucleic acid
maaatcagracagtryt

SEQ ID NO: 7875 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (3)..(3): base is a locked nucleic acid
  modified_base (8)..(8): base is a locked nucleic acid
  modified_base (9)..(9): base is a locked nucleic acid
maaatcagracagtryt

SEQ ID NO: 7876 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (4)..(4): base is a locked nucleic acid
  modified_base (8)..(8): base is a locked nucleic acid
  modified_base (9)..(9): base is a locked nucleic acid
maaatcagracagtryt

SEQ ID NO: 7877 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (2)..(2): base is a locked nucleic acid
  modified_base (8)..(8): base is a locked nucleic acid
  modified_base (9)..(9): base is a locked nucleic acid
maaatcagracagtryt

SEQ ID NO: 7878 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (6)..(6): base is a locked nucleic acid
  modified_base (8)..(8): base is a locked nucleic acid
  modified_base (9)..(9): base is a locked nucleic acid
maaatcagracagtryt

SEQ ID NO: 7879 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (5)..(5): base is a locked nucleic acid
  modified_base (8)..(8): base is a locked nucleic acid
  modified_base (9)..(9): base is a locked nucleic acid
maaatcagracagtryt

SEQ ID NO: 7880 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (1)..(1): base is a locked nucleic acid
  modified_base (8)..(8): base is a locked nucleic acid
  modified_base (9)..(9): base is a locked nucleic acid
maaatcagracagtryt

SEQ ID NO: 7881 - DNA, 17 bp, Artificial Sequence
  Oligonucleotide probe
  misc_binding (1)..(17): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
maaatcagracagtryt

SEQ ID NO: 7882 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (11)..(11): base is a locked nucleic acid
maaatcagracagtr

SEQ ID NO: 7883 - DNA, 16 bp, Artificial Sequence
  Oligonucleotide probe
  misc_binding (1)..(16): Hybridization probe for the specific detection of mutant HIV-1 at codon 106 of the reverse transcriptase gene.
maaatcagracagtry

SEQ ID NO: 7884 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (10)..(10): base is a locked nucleic acid
maaatcagracagtr

SEQ ID NO: 7885 - DNA, 15 bp, Artificial Sequence
  Oligonucleotide probe
  misc_binding (1)..(15): Hybridization probe for the specific detection of mutant HIV-1 at codon 106 of the reverse transcriptase gene.
maaatcagracagtr

SEQ ID NO: 7886 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (15)..(15): base is a locked nucleic acid
maaatcagracagtr

SEQ ID NO: 7887 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (13)..(13): base is a locked nucleic acid
maaatcagracagtr

SEQ ID NO: 7888 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (5)..(5): base is a locked nucleic acid
maaatcagracagtr

SEQ ID NO: 7889 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (4)..(4): base is a locked nucleic acid
maaatcagracagtr

SEQ ID NO: 7890 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (6)..(6): base is a locked nucleic acid
maaatcagracagtr

SEQ ID NO: 7891 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (8)..(8): base is a locked nucleic acid
maaatcagracagtr

SEQ ID NO: 7892 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (3)..(3): base is a locked nucleic acid
maaatcagracagtr

SEQ ID NO: 7893 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (2)..(2): base is a locked nucleic acid
maaatcagracagtr

SEQ ID NO: 7894 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (7)..(7): base is a locked nucleic acid
maaatcagracagtr

SEQ ID NO: 7895 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (1)..(1): base is a locked nucleic acid
maaatcagracagtr

SEQ ID NO: 7896 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
maaatcagracagtr

SEQ ID NO: 7897 - DNA, 16 bp, Artificial Sequence
  Oligonucleotide probe
  misc_binding (1)..(16): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
maaatcagracagtry

SEQ ID NO: 7898 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (11)..(11): base is a locked nucleic acid
maaatcagracagtr

SEQ ID NO: 7899 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (13)..(13): base is a locked nucleic acid
maaatcagracagtr

SEQ ID NO: 7900 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (10)..(10): base is a locked nucleic acid
maaatcagracagtr

SEQ ID NO: 7901 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (15)..(15): base is a locked nucleic acid
maaatcagracagtr

SEQ ID NO: 7902 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (3)..(3): base is a locked nucleic acid
  modified_base (8)..(8): base is a locked nucleic acid
  modified_base (9)..(9): base is a locked nucleic acid
maaatcagracagtr

SEQ ID NO: 7903 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (4)..(4): base is a locked nucleic acid
  modified_base (8)..(8): base is a locked nucleic acid
  modified_base (9)..(9): base is a locked nucleic acid
maaatcagracagtr

SEQ ID NO: 7904 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (2)..(2): base is a locked nucleic acid
  modified_base (8)..(8): base is a locked nucleic acid
  modified_base (9)..(9): base is a locked nucleic acid
maaatcagracagtr

SEQ ID NO: 7905 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (6)..(6): base is a locked nucleic acid
  modified_base (8)..(8): base is a locked nucleic acid
  modified_base (9)..(9): base is a locked nucleic acid
maaatcagracagtr

SEQ ID NO: 7906 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (5)..(5): base is a locked nucleic acid
  modified_base (8)..(8): base is a locked nucleic acid
  modified_base (9)..(9): base is a locked nucleic acid
maaatcagracagtr

SEQ ID NO: 7907 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (1)..(1): base is a locked nucleic acid
  modified_base (8)..(8): base is a locked nucleic acid
  modified_base (9)..(9): base is a locked nucleic acid
maaatcagracagtr

SEQ ID NO: 7908 - DNA, 15 bp, Artificial Sequence
  Oligonucleotide probe
  misc_binding (1)..(15): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
maaatcagracagtr

SEQ ID NO: 7909 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (11)..(11): base is a locked nucleic acid
maaatcagracag

SEQ ID NO: 7910 - DNA, 14 bp, Artificial Sequence
  Oligonucleotide probe
  misc_binding (1)..(14): Hybridization probe for the specific detection of mutant HIV-1 at codon 106 of the reverse transcriptase gene.
maaatcagracagt

SEQ ID NO: 7911 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (10)..(10): base is a locked nucleic acid
maaatcagracag

SEQ ID NO: 7912 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (13)..(13): base is a locked nucleic acid
maaatcagracag

SEQ ID NO: 7913 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (5)..(5): base is a locked nucleic acid
maaatcagracag

SEQ ID NO: 7914 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (4)..(4): base is a locked nucleic acid
maaatcagracag

SEQ ID NO: 7915 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (6)..(6): base is a locked nucleic acid
maaatcagracag

SEQ ID NO: 7916 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (8)..(8): base is a locked nucleic acid
maaatcagracag

SEQ ID NO: 7917 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (3)..(3): base is a locked nucleic acid
maaatcagracag

SEQ ID NO: 7918 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (2)..(2): base is a locked nucleic acid
maaatcagracag

SEQ ID NO: 7919 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (7)..(7): base is a locked nucleic acid
maaatcagracag

SEQ ID NO: 7920 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (1)..(1): base is a locked nucleic acid
maaatcagracag

SEQ ID NO: 7921 - DNA, 14 bp, Artificial Sequence
  Oligonucleotide probe
  misc_binding (1)..(14): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
maaatcagracagt

SEQ ID NO: 7922 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (11)..(11): base is a locked nucleic acid
maaatcagracag

SEQ ID NO: 7923 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (13)..(13): base is a locked nucleic acid
maaatcagracag

SEQ ID NO: 7924 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
  modified_base (10)..(10): base is a locked nucleic acid
maaatcagracag

SEQ ID NO: 7925 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (3)..(3): base is a locked nucleic acid
  modified_base (8)..(8): base is a locked nucleic acid
  modified_base (9)..(9): base is a locked nucleic acid
maaatcagracag

SEQ ID NO: 7926 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (4)..(4): base is a locked nucleic acid
  modified_base (8)..(8): base is a locked nucleic acid
  modified_base (9)..(9): base is a locked nucleic acid
maaatcagracag

SEQ ID NO: 7927 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (2)..(2): base is a locked nucleic acid
  modified_base (8)..(8): base is a locked nucleic acid
  modified_base (9)..(9): base is a locked nucleic acid
maaatcagracag

SEQ ID NO: 7928 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (6)..(6): base is a locked nucleic acid
  modified_base (8)..(8): base is a locked nucleic acid
  modified_base (9)..(9): base is a locked nucleic acid
maaatcagracag

SEQ ID NO: 7929 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (5)..(5): base is a locked nucleic acid
  modified_base (8)..(8): base is a locked nucleic acid
  modified_base (9)..(9): base is a locked nucleic acid
maaatcagracag

SEQ ID NO: 7930 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (1)..(1): base is a locked nucleic acid
  modified_base (8)..(8): base is a locked nucleic acid
  modified_base (9)..(9): base is a locked nucleic acid
maaatcagracag

SEQ ID NO: 7931 - DNA, 13 bp, Artificial Sequence
  Oligonucleotide probe
  misc_binding (1)..(13): Hybridization probe for the specific detection of mutant HIV-1 at codon 106 of the reverse transcriptase gene.
  modified_base (8)..(8): base is a locked nucleic acid
  modified_base (9)..(9): base is a locked nucleic acid
maaatcagracag

SEQ ID NO: 7932 - DNA, 15 bp, Artificial Sequence
  Oligonucleotide probe
  misc_binding (1)..(15): Hybridization probe for the specific detection of mutant HIV-1 at codon 106 of the reverse transcriptase gene.
aaatcagcracagta

SEQ ID NO: 7933 - DNA, 15 bp, Artificial Sequence
  Oligonucleotide probe
  misc_binding (1)..(15): Hybridization probe for the specific detection of mutant HIV-1 at codon 106 of the reverse transcriptase gene.
aaatcaatgacagta

SEQ ID NO: 7934 - DNA, 18 bp, Artificial Sequence
  Oligonucleotide probe
  misc_binding (1)..(18): Hybridization probe for the specific detection of mutant HIV-1 at codon 106 of the reverse transcriptase gene.
amaaatcagracagtryt

SEQ ID NO: 7935 - DNA, 17 bp, Artificial Sequence
  Oligonucleotide probe
  misc_binding (1)..(17): Hybridization probe for the specific detection of mutant HIV-1 at codon 106 of the reverse transcriptase gene.
maaatcagracagtryt

SEQ ID NO: 7936 - DNA, 15 bp, Artificial Sequence
  Oligonucleotide probe
  misc_binding (1)..(15): Hybridization probe for the specific detection of mutant HIV-1 at codon 106 of the reverse transcriptase gene.
maaatcagracagtr

SEQ ID NO: 7937 - DNA, 13 bp, Artificial Sequence
  Oligonucleotide probe
  misc_binding (1)..(13): Hybridization probe for the specific detection of mutant HIV-1 at codon 106 of the reverse transcriptase gene.
maaatcagracag

SEQ ID NO: 7938 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (11)..(11): base is a locked nucleic acid
tcagtracatrytrgatg

SEQ ID NO: 7939 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (13)..(13): base is a locked nucleic acid
tcagtracatrytrgatg

SEQ ID NO: 7940 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (16)..(16): base is a locked nucleic acid
tcagtracatrytrgatg

SEQ ID NO: 7941 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (15)..(15): base is a locked nucleic acid
tcagtracatrytrgatg

SEQ ID NO: 7942 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (3)..(3): base is a locked nucleic acid
tcagtracatrytrgatg

SEQ ID NO: 7943 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (2)..(2): base is a locked nucleic acid
tcagtracatrytrgatg

SEQ ID NO: 7944 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (4)..(4): base is a locked nucleic acid
tcagtracatrytrgatg

SEQ ID NO: 7945 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (6)..(6): base is a locked nucleic acid
tcagtracatrytrgatg

SEQ ID NO: 7946 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (9)..(9): base is a locked nucleic acid
  modified_base (10)..(10): base is a locked nucleic acid
  modified_base (15)..(15): base is a locked nucleic acid
tcagtracatrytrgatg

SEQ ID NO: 7947 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (9)..(9): base is a locked nucleic acid
  modified_base (10)..(10): base is a locked nucleic acid
  modified_base (18)..(18): base is a locked nucleic acid
tcagtracatrytrgatg

SEQ ID NO: 7948 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (9)..(9): base is a locked nucleic acid
  modified_base (10)..(10): base is a locked nucleic acid
  modified_base (14)..(14): base is a locked nucleic acid
tcagtracatrytrgatg

SEQ ID NO: 7949 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (9)..(9): base is a locked nucleic acid
  modified_base (10)..(10): base is a locked nucleic acid
  modified_base (12)..(12): base is a locked nucleic acid
tcagtracatrytrgatg

SEQ ID NO: 7950 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (5)..(5): base is a locked nucleic acid
  modified_base (9)..(9): base is a locked nucleic acid
  modified_base (10)..(10): base is a locked nucleic acid
tcagtracatrytrgatg

SEQ ID NO: 7951 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (3)..(3): base is a locked nucleic acid
  modified_base (9)..(9): base is a locked nucleic acid
  modified_base (10)..(10): base is a locked nucleic acid
tcagtracatrytrgatg

SEQ ID NO: 7952 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (4)..(4): base is a locked nucleic acid
  modified_base (9)..(9): base is a locked nucleic acid
  modified_base (10)..(10): base is a locked nucleic acid
tcagtracatrytrgatg

SEQ ID NO: 7953 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (10)..(10): base is a locked nucleic acid
tcagtracatrytrgatg

SEQ ID NO: 7954 - DNA, 18 bp, Artificial Sequence
  Oligonucleotide probe
  misc_binding (1)..(18): Hybridization probe for the specific detection of mutant HIV-1 at codon 108 of the reverse transcriptase gene.
  modified_base (9)..(9): base is a locked nucleic acid
  modified_base (10)..(10): base is a locked nucleic acid
tcagtracatrytrgatg

SEQ ID NO: 7955 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (10)..(10): base is a locked nucleic acid
cagtracatrytrgatg

SEQ ID NO: 7956 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (12)..(12): base is a locked nucleic acid
cagtracatrytrgatg

SEQ ID NO: 7957 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (15)..(15): base is a locked nucleic acid
cagtracatrytrgatg

SEQ ID NO: 7958 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (14)..(14): base is a locked nucleic acid
cagtracatrytrgatg

SEQ ID NO: 7959 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (2)..(2): base is a locked nucleic acid
cagtracatrytrgatg

SEQ ID NO: 7960 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (1)..(1): base is a locked nucleic acid
cagtracatrytrgatg

SEQ ID NO: 7961 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (3)..(3): base is a locked nucleic acid
cagtracatrytrgatg

SEQ ID NO: 7962 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (5)..(5): base is a locked nucleic acid
cagtracatrytrgatg

SEQ ID NO: 7963 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (14)..(14): base is a locked nucleic acid
cagtracatrytrgatg

SEQ ID NO: 7964 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (17)..(17): base is a locked nucleic acid
cagtracatrytrgatg

SEQ ID NO: 7965 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (13)..(13): base is a locked nucleic acid
cagtracatrytrgatg

SEQ ID NO: 7966 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (11)..(11): base is a locked nucleic acid
cagtracatrytrgatg

SEQ ID NO: 7967 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (4)..(4): base is a locked nucleic acid
  modified_base (8)..(8): base is a locked nucleic acid
  modified_base (9)..(9): base is a locked nucleic acid
cagtracatrytrgatg

SEQ ID NO: 7968 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (2)..(2): base is a locked nucleic acid
  modified_base (8)..(8): base is a locked nucleic acid
  modified_base (9)..(9): base is a locked nucleic acid
cagtracatrytrgatg

SEQ ID NO: 7969 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (3)..(3): base is a locked nucleic acid
  modified_base (8)..(8): base is a locked nucleic acid
  modified_base (9)..(9): base is a locked nucleic acid
cagtracatrytrgatg

SEQ ID NO: 7970 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (7)..(7): base is a locked nucleic acid
  modified_base (8)..(8): base is a locked nucleic acid
  modified_base (9)..(9): base is a locked nucleic acid
cagtracatrytrgatg

SEQ ID NO: 7971 - DNA, 17 bp, Artificial Sequence
  Oligonucleotide probe
  misc_binding (1)..(17): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
cagtracatrytrgatg

SEQ ID NO: 7972 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (10)..(10): base is a locked nucleic acid
cagtracatrytrga

SEQ ID NO: 7973 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (12)..(12): base is a locked nucleic acid
cagtracatrytrga

SEQ ID NO: 7974 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (15)..(15): base is a locked nucleic acid
cagtracatrytrga

SEQ ID NO: 7975 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (14)..(14): base is a locked nucleic acid
cagtracatrytrga

SEQ ID NO: 7976 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (2)..(2): base is a locked nucleic acid
cagtracatrytrga

SEQ ID NO: 7977 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (1)..(1): base is a locked nucleic acid
cagtracatrytrga

SEQ ID NO: 7978 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (3)..(3): base is a locked nucleic acid
cagtracatrytrga

SEQ ID NO: 7979 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (5)..(5): base is a locked nucleic acid
cagtracatrytrga

SEQ ID NO: 7980 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (14)..(14): base is a locked nucleic acid
cagtracatrytrga

SEQ ID NO: 7981 - DNA, 16 bp, Artificial Sequence
  Oligonucleotide probe
  misc_binding (1)..(16): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
cagtracatrytrgat

SEQ ID NO: 7982 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (13)..(13): base is a locked nucleic acid
cagtracatrytrga

SEQ ID NO: 7983 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (11)..(11): base is a locked nucleic acid
cagtracatrytrga

SEQ ID NO: 7984 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (4)..(4): base is a locked nucleic acid
  modified_base (8)..(8): base is a locked nucleic acid
  modified_base (9)..(9): base is a locked nucleic acid
cagtracatrytrga

SEQ ID NO: 7985 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (2)..(2): base is a locked nucleic acid
  modified_base (8)..(8): base is a locked nucleic acid
  modified_base (9)..(9): base is a locked nucleic acid
cagtracatrytrga

SEQ ID NO: 7986 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (3)..(3): base is a locked nucleic acid
  modified_base (8)..(8): base is a locked nucleic acid
  modified_base (9)..(9): base is a locked nucleic acid
cagtracatrytrga

SEQ ID NO: 7987 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (7)..(7): base is a locked nucleic acid
  modified_base (8)..(8): base is a locked nucleic acid
  modified_base (9)..(9): base is a locked nucleic acid
cagtracatrytrga

SEQ ID NO: 7988 - DNA, 15 bp, Artificial Sequence
  Oligonucleotide probe
  misc_binding (1)..(15): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
cagtracatrytrga

SEQ ID NO: 7989 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (10)..(10): base is a locked nucleic acid
cagtracatrytr

SEQ ID NO: 7990 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (12)..(12): base is a locked nucleic acid
cagtracatrytr

SEQ ID NO: 7991 - DNA, 14 bp, Artificial Sequence
  Oligonucleotide probe
  misc_binding (1)..(14): Hybridization probe for the specific detection of mutant HIV-1 at codon 108 of the reverse transcriptase gene.
cagtracatrytrg

SEQ ID NO: 7992 - DNA, 13 bp, Artificial Sequence
  Oligonucleotide probe
  misc_binding (1)..(13): Hybridization probe for the specific detection of mutant HIV-1 at codon 108 of the reverse transcriptase gene.
cagtracatrytr

SEQ ID NO: 7993 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (2)..(2): base is a locked nucleic acid
cagtracatrytr

SEQ ID NO: 7994 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (1)..(1): base is a locked nucleic acid
cagtracatrytr

SEQ ID NO: 7995 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (3)..(3): base is a locked nucleic acid
cagtracatrytr

SEQ ID NO: 7996 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (5)..(5): base is a locked nucleic acid
cagtracatrytr

SEQ ID NO: 7997 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
cagtracatrytr

SEQ ID NO: 7998 - DNA, 14 bp, Artificial Sequence
  Oligonucleotide probe
  misc_binding (1)..(14): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
cagtracatrytrg

SEQ ID NO: 7999 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (13)..(13): base is a locked nucleic acid
cagtracatrytr

SEQ ID NO: 8000 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
  modified_base (11)..(11): base is a locked nucleic acid
cagtracatrytr

SEQ ID NO: 8001 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (4)..(4): base is a locked nucleic acid
  modified_base (8)..(8): base is a locked nucleic acid
  modified_base (9)..(9): base is a locked nucleic acid
cagtracatrytr

SEQ ID NO: 8002 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (2)..(2): base is a locked nucleic acid
  modified_base (8)..(8): base is a locked nucleic acid
  modified_base (9)..(9): base is a locked nucleic acid
cagtracatrytr

SEQ ID NO: 8003 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (3)..(3): base is a locked nucleic acid
  modified_base (8)..(8): base is a locked nucleic acid
  modified_base (9)..(9): base is a locked nucleic acid
cagtracatrytr

SEQ ID NO: 8004 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (7)..(7): base is a locked nucleic acid
  modified_base (8)..(8): base is a locked nucleic acid
  modified_base (9)..(9): base is a locked nucleic acid
cagtracatrytr

SEQ ID NO: 8005 - DNA, 13 bp, Artificial Sequence
  Oligonucleotide probe
  misc_binding (1)..(13): Hybridization probe for the specific detection of mutant HIV-1 at codon 108 of the reverse transcriptase gene.
  modified_base (8)..(8): base is a locked nucleic acid
  modified_base (9)..(9): base is a locked nucleic acid
cagtracatrytr

SEQ ID NO: 8006 - DNA, 15 bp, Artificial Sequence
  Oligonucleotide probe
  misc_binding (1)..(15): Hybridization probe for the specific detection of mutant HIV-1 at codon 108 of the reverse transcriptase gene.
aaaatcaathacagt

SEQ ID NO: 8007 - DNA, 18 bp, Artificial Sequence
  Oligonucleotide probe
  misc_binding (1)..(18): Hybridization probe for the specific detection of mutant HIV-1 at codon 108 of the reverse transcriptase gene.
tcagtracatrytrgatg

SEQ ID NO: 8008 - DNA, 17 bp, Artificial Sequence
  Oligonucleotide probe
  misc_binding (1)..(17): Hybridization probe for the specific detection of mutant HIV-1 at codon 108 of the reverse transcriptase gene.
cagtracatrytrgatg

SEQ ID NO: 8009 - DNA, 15 bp, Artificial Sequence
  Oligonucleotide probe
  misc_binding (1)..(15): Hybridization probe for the specific detection of mutant HIV-1 at codon 108 of the reverse transcriptase gene.
cagtracatrytrga

SEQ ID NO: 8010 - DNA, 16 bp, Artificial Sequence
  Oligonucleotide probe
  misc_binding (1)..(16): Hybridization probe for the specific detection of mutant HIV-1 at codon 108 of the reverse transcriptase gene.
cagtracatrytrgat

SEQ ID NO: 8011 - DNA, 13 bp, Artificial Sequence
  Oligonucleotide probe
  misc_binding (1)..(13): Hybridization probe for the specific detection of mutant HIV-1 at codon 108 of the reverse transcriptase gene.
cagtracatrytr

SEQ ID NO: 8012 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (11)..(11): base is a locked nucleic acid
gdgaygcatyttytcagt

SEQ ID NO: 8013 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (13)..(13): base is a locked nucleic acid
gdgaygcatyttytcagt

SEQ ID NO: 8014 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (10)..(10): base is a locked nucleic acid
gdgaygcatyttytcagt

SEQ ID NO: 8015 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (18)..(18): base is a locked nucleic acid
gdgaygcatyttytcagt

SEQ ID NO: 8016 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (8)..(8): base is a locked nucleic acid
gdgaygcatyttytcagt

SEQ ID NO: 8017 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (5)..(5): base is a locked nucleic acid
gdgaygcatyttytcagt

SEQ ID NO: 8018 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (2)..(2): base is a locked nucleic acid
gdgaygcatyttytcagt

SEQ ID NO: 8019 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (4)..(4): base is a locked nucleic acid
gdgaygcatyttytcagt

SEQ ID NO: 8020 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (9)..(9): base is a locked nucleic acid
  modified_base (10)..(10): base is a locked nucleic acid
  modified_base (12)..(12): base is a locked nucleic acid
gdgaygcatyttytcagt

SEQ ID NO: 8021 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (9)..(9): base is a locked nucleic acid
  modified_base (10)..(10): base is a locked nucleic acid
  modified_base (17)..(17): base is a locked nucleic acid
gdgaygcatyttytcagt

SEQ ID NO: 8022 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (9)..(9): base is a locked nucleic acid
  modified_base (10)..(10): base is a locked nucleic acid
  modified_base (11)..(11): base is a locked nucleic acid
gdgaygcatyttytcagt

SEQ ID NO: 8023 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (9)..(9): base is a locked nucleic acid
  modified_base (10)..(10): base is a locked nucleic acid
  modified_base (13)..(13): base is a locked nucleic acid
gdgaygcatyttytcagt

SEQ ID NO: 8024 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (4)..(4): base is a locked nucleic acid
  modified_base (9)..(9): base is a locked nucleic acid
  modified_base (10)..(10): base is a locked nucleic acid
gdgaygcatyttytcagt

SEQ ID NO: 8025 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (3)..(3): base is a locked nucleic acid
  modified_base (9)..(9): base is a locked nucleic acid
  modified_base (10)..(10): base is a locked nucleic acid
gdgaygcatyttytcagt

SEQ ID NO: 8026 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (6)..(6): base is a locked nucleic acid
  modified_base (9)..(9): base is a locked nucleic acid
  modified_base (10)..(10): base is a locked nucleic acid
gdgaygcatyttytcagt

SEQ ID NO: 8027 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (10)..(10): base is a locked nucleic acid
gdgaygcatyttytcagt

SEQ ID NO: 8028 - DNA, 18 bp, Artificial Sequence
  Oligonucleotide probe
  misc_binding (1)..(18): Hybridization probe for the specific detection of mutant HIV-1 at codon 115 of the reverse transcriptase gene.
  modified_base (9)..(9): base is a locked nucleic acid
  modified_base (10)..(10): base is a locked nucleic acid
gdgaygcatyttytcagt

SEQ ID NO: 8029 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (10)..(10): base is a locked nucleic acid
dgaygcatyttytcagt

SEQ ID NO: 8030 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (12)..(12): base is a locked nucleic acid
dgaygcatyttytcagt

SEQ ID NO: 8031 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (9)..(9): base is a locked nucleic acid
dgaygcatyttytcagt

SEQ ID NO: 8032 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (17)..(17): base is a locked nucleic acid
dgaygcatyttytcagt

SEQ ID NO: 8033 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (7)..(7): base is a locked nucleic acid
dgaygcatyttytcagt

SEQ ID NO: 8034 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (4)..(4): base is a locked nucleic acid
dgaygcatyttytcagt

SEQ ID NO: 8035 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (1)..(1): base is a locked nucleic acid
dgaygcatyttytcagt

SEQ ID NO: 8036 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (3)..(3): base is a locked nucleic acid
dgaygcatyttytcagt

SEQ ID NO: 8037 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (11)..(11): base is a locked nucleic acid
dgaygcatyttytcagt

SEQ ID NO: 8038 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (16)..(16): base is a locked nucleic acid
dgaygcatyttytcagt

SEQ ID NO: 8039 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (10)..(10): base is a locked nucleic acid
dgaygcatyttytcagt

SEQ ID NO: 8040 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (12)..(12): base is a locked nucleic acid
dgaygcatyttytcagt

SEQ ID NO: 8041 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (3)..(3): base is a locked nucleic acid
  modified_base (8)..(8): base is a locked nucleic acid
  modified_base (9)..(9): base is a locked nucleic acid
dgaygcatyttytcagt

SEQ ID NO: 8042 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (2)..(2): base is a locked nucleic acid
  modified_base (8)..(8): base is a locked nucleic acid
  modified_base (9)..(9): base is a locked nucleic acid
dgaygcatyttytcagt

SEQ ID NO: 8043 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (5)..(5): base is a locked nucleic acid
  modified_base (8)..(8): base is a locked nucleic acid
  modified_base (9)..(9): base is a locked nucleic acid
dgaygcatyttytcagt

SEQ ID NO: 8044 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (7)..(7): base is a locked nucleic acid
  modified_base (8)..(8): base is a locked nucleic acid
  modified_base (9)..(9): base is a locked nucleic acid
dgaygcatyttytcagt

SEQ ID NO: 8045 - DNA, 17 bp, Artificial Sequence
  Oligonucleotide probe
  misc_binding (1)..(17): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
dgaygcatyttytcagt

SEQ ID NO: 8046 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (10)..(10): base is a locked nucleic acid
dgaygcatyttytca

SEQ ID NO: 8047 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (12)..(12): base is a locked nucleic acid
dgaygcatyttytca

SEQ ID NO: 8048 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (9)..(9): base is a locked nucleic acid
dgaygcatyttytca

SEQ ID NO: 8049 - DNA, 16 bp, Artificial Sequence
  Oligonucleotide probe
  misc_binding (1)..(16): Hybridization probe for the specific detection of mutant HIV-1 at codon 115 of the reverse transcriptase gene.
dgaygcatyttytcag

SEQ ID NO: 8050 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (7)..(7): base is a locked nucleic acid
dgaygcatyttytca

SEQ ID NO: 8051 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (4)..(4): base is a locked nucleic acid
dgaygcatyttytca

SEQ ID NO: 8052 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (1)..(1): base is a locked nucleic acid
dgaygcatyttytca

SEQ ID NO: 8053 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (3)..(3): base is a locked nucleic acid
dgaygcatyttytca

SEQ ID NO: 8054 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (11)..(11): base is a locked nucleic acid
dgaygcatyttytca

SEQ ID NO: 8055 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
dgaygcatyttytca

SEQ ID NO: 8056 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (10)..(10): base is a locked nucleic acid
dgaygcatyttytca

SEQ ID NO: 8057 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (12)..(12): base is a locked nucleic acid
dgaygcatyttytca

SEQ ID NO: 8058 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (3)..(3): base is a locked nucleic acid
  modified_base (8)..(8): base is a locked nucleic acid
  modified_base (9)..(9): base is a locked nucleic acid
dgaygcatyttytca

SEQ ID NO: 8059 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (2)..(2): base is a locked nucleic acid
  modified_base (8)..(8): base is a locked nucleic acid
  modified_base (9)..(9): base is a locked nucleic acid
dgaygcatyttytca

SEQ ID NO: 8060 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (5)..(5): base is a locked nucleic acid
  modified_base (8)..(8): base is a locked nucleic acid
  modified_base (9)..(9): base is a locked nucleic acid
dgaygcatyttytca

SEQ ID NO: 8061 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (7)..(7): base is a locked nucleic acid
  modified_base (8)..(8): base is a locked nucleic acid
  modified_base (9)..(9): base is a locked nucleic acid
dgaygcatyttytca

SEQ ID NO: 8062 - DNA, 15 bp, Artificial Sequence
  Oligonucleotide probe
  misc_binding (1)..(15): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
dgaygcatyttytca

SEQ ID NO: 8063 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (10)..(10): base is a locked nucleic acid
dgaygcatyttyt

SEQ ID NO: 8064 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (12)..(12): base is a locked nucleic acid
dgaygcatyttyt

SEQ ID NO: 8065 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (9)..(9): base is a locked nucleic acid
dgaygcatyttyt

SEQ ID NO: 8066 - DNA, 14 bp, Artificial Sequence
  Oligonucleotide probe
  misc_binding (1)..(14): Hybridization probe for the specific detection of mutant HIV-1 at codon 115 of the reverse transcriptase gene.
dgaygcatyttytc

SEQ ID NO: 8067 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (7)..(7): base is a locked nucleic acid
dgaygcatyttyt

SEQ ID NO: 8068 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (4)..(4): base is a locked nucleic acid
dgaygcatyttyt

SEQ ID NO: 8069 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (1)..(1): base is a locked nucleic acid
dgaygcatyttyt

SEQ ID NO: 8070 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (3)..(3): base is a locked nucleic acid
dgaygcatyttyt

SEQ ID NO: 8071 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (11)..(11): base is a locked nucleic acid
dgaygcatyttyt

SEQ ID NO: 8072 - DNA, 14 bp, Artificial Sequence
  Oligonucleotide probe
  misc_binding (1)..(14): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
dgaygcatyttytc

SEQ ID NO: 8073 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (10)..(10): base is a locked nucleic acid
dgaygcatyttyt

SEQ ID NO: 8074 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
  modified_base (12)..(12): base is a locked nucleic acid
dgaygcatyttyt

SEQ ID NO: 8075 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (3)..(3): base is a locked nucleic acid
  modified_base (8)..(8): base is a locked nucleic acid
  modified_base (9)..(9): base is a locked nucleic acid
dgaygcatyttyt

SEQ ID NO: 8076 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (2)..(2): base is a locked nucleic acid
  modified_base (8)..(8): base is a locked nucleic acid
  modified_base (9)..(9): base is a locked nucleic acid
dgaygcatyttyt

SEQ ID NO: 8077 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (5)..(5): base is a locked nucleic acid
  modified_base (8)..(8): base is a locked nucleic acid
  modified_base (9)..(9): base is a locked nucleic acid
dgaygcatyttyt

SEQ ID NO: 8078 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (7)..(7): base is a locked nucleic acid
  modified_base (8)..(8): base is a locked nucleic acid
  modified_base (9)..(9): base is a locked nucleic acid
dgaygcatyttyt

SEQ ID NO: 8079 - DNA, 13 bp, Artificial Sequence
  Oligonucleotide probe
  misc_binding (1)..(13): Hybridization probe for the specific detection of mutant HIV-1 at codon 115 of the reverse transcriptase gene.
  modified_base (8)..(8): base is a locked nucleic acid
  modified_base (9)..(9): base is a locked nucleic acid
dgaygcatyttyt

SEQ ID NO: 8080 - DNA, 15 bp, Artificial Sequence
  Oligonucleotide probe
  misc_binding (1)..(15): Hybridization probe for the specific detection of mutant HIV-1 at codon 115 of the reverse transcriptase gene.
tgaaaaraatgcatc

SEQ ID NO: 8081 - DNA, 18 bp, Artificial Sequence
  Oligonucleotide probe
  misc_binding (1)..(18): Hybridization probe for the specific detection of mutant HIV-1 at codon 115 of the reverse transcriptase gene.
gdgaygcatyttytcagt

SEQ ID NO: 8082 - DNA, 17 bp, Artificial Sequence
  Oligonucleotide probe
  misc_binding (1)..(17): Hybridization probe for the specific detection of mutant HIV-1 at codon 115 of the reverse transcriptase gene.
dgaygcatyttytcagt

SEQ ID NO: 8083 - DNA, 15 bp, Artificial Sequence
  Oligonucleotide probe
  misc_binding (1)..(15): Hybridization probe for the specific detection of mutant HIV-1 at codon 115 of the reverse transcriptase gene.
dgaygcatyttytca

SEQ ID NO: 8084 - DNA, 13 bp, Artificial Sequence
  Oligonucleotide probe
  misc_binding (1)..(13): Hybridization probe for the specific detection of mutant HIV-1 at codon 115 of the reverse transcriptase gene.
dgaygcatyttyt

SEQ ID NO: 8085 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (17)..(17): base is a locked nucleic acid
aygcataytytcagtycc

SEQ ID NO: 8086 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (10)..(10): base is a locked nucleic acid
aygcataytytcagtycc

SEQ ID NO: 8087 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (18)..(18): base is a locked nucleic acid
aygcataytytcagtycc

SEQ ID NO: 8088 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (12)..(12): base is a locked nucleic acid
aygcataytytcagtycc

SEQ ID NO: 8089 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (9)..(9): base is a locked nucleic acid
aygcataytytcagtycc

SEQ ID NO: 8090 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (3)..(3): base is a locked nucleic acid
aygcataytytcagtycc

SEQ ID NO: 8091 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (4)..(4): base is a locked nucleic acid
aygcataytytcagtycc

SEQ ID NO: 8092 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (8)..(8): base is a locked nucleic acid
aygcataytytcagtycc

SEQ ID NO: 8093 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (9)..(9): base is a locked nucleic acid
  modified_base (10)..(10): base is a locked nucleic acid
  modified_base (11)..(11): base is a locked nucleic acid
aygcataytytcagtycc

SEQ ID NO: 8094 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (9)..(9): base is a locked nucleic acid
  modified_base (10)..(10): base is a locked nucleic acid
  modified_base (14)..(14): base is a locked nucleic acid
aygcataytytcagtycc

SEQ ID NO: 8095 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (9)..(9): base is a locked nucleic acid
  modified_base (10)..(10): base is a locked nucleic acid
  modified_base (13)..(13): base is a locked nucleic acid
aygcataytytcagtycc

SEQ ID NO: 8096 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (9)..(9): base is a locked nucleic acid
  modified_base (10)..(10): base is a locked nucleic acid
  modified_base (18)..(18): base is a locked nucleic acid
aygcataytytcagtycc

SEQ ID NO: 8097 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (5)..(5): base is a locked nucleic acid
  modified_base (9)..(9): base is a locked nucleic acid
  modified_base (10)..(10): base is a locked nucleic acid
aygcataytytcagtycc

SEQ ID NO: 8098 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (4)..(4): base is a locked nucleic acid
  modified_base (9)..(9): base is a locked nucleic acid
  modified_base (10)..(10): base is a locked nucleic acid
aygcataytytcagtycc

SEQ ID NO: 8099 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (7)..(7): base is a locked nucleic acid
  modified_base (9)..(9): base is a locked nucleic acid
  modified_base (10)..(10): base is a locked nucleic acid
aygcataytytcagtycc

SEQ ID NO: 8100 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (3)..(3): base is a locked nucleic acid
  modified_base (9)..(9): base is a locked nucleic acid
  modified_base (10)..(10): base is a locked nucleic acid
aygcataytytcagtycc

SEQ ID NO: 8101 - DNA, 18 bp, Artificial Sequence
  Oligonucleotide probe
  misc_binding (1)..(18): Hybridization probe for the specific detection of mutant HIV-1 at codon 116 of the reverse transcriptase gene.
  modified_base (9)..(9): base is a locked nucleic acid
  modified_base (10)..(10): base is a locked nucleic acid
aygcataytytcagtycc

SEQ ID NO: 8102 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (16)..(16): base is a locked nucleic acid
ygcataytytcagtycc

SEQ ID NO: 8103 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (9)..(9): base is a locked nucleic acid
ygcataytytcagtycc

SEQ ID NO: 8104 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (17)..(17): base is a locked nucleic acid
ygcataytytcagtycc

SEQ ID NO: 8105 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (11)..(11): base is a locked nucleic acid
ygcataytytcagtycc

SEQ ID NO: 8106 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (8)..(8): base is a locked nucleic acid
ygcataytytcagtycc

SEQ ID NO: 8107 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (2)..(2): base is a locked nucleic acid
ygcataytytcagtycc

SEQ ID NO: 8108 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (3)..(3): base is a locked nucleic acid
ygcataytytcagtycc

SEQ ID NO: 8109 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (7)..(7): base is a locked nucleic acid
ygcataytytcagtycc

SEQ ID NO: 8110 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (10)..(10): base is a locked nucleic acid
ygcataytytcagtycc

SEQ ID NO: 8111 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (13)..(13): base is a locked nucleic acid
ygcataytytcagtycc

SEQ ID NO: 8112 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (12)..(12): base is a locked nucleic acid
ygcataytytcagtycc

SEQ ID NO: 8113 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (17)..(17): base is a locked nucleic acid
ygcataytytcagtycc

SEQ ID NO: 8114 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (4)..(4): base is a locked nucleic acid
  modified_base (8)..(8): base is a locked nucleic acid
  modified_base (9)..(9): base is a locked nucleic acid
ygcataytytcagtycc

SEQ ID NO: 8115 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (3)..(3): base is a locked nucleic acid
  modified_base (8)..(8): base is a locked nucleic acid
  modified_base (9)..(9): base is a locked nucleic acid
ygcataytytcagtycc

SEQ ID NO: 8116 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (6)..(6): base is a locked nucleic acid
  modified_base (8)..(8): base is a locked nucleic acid
  modified_base (9)..(9): base is a locked nucleic acid
ygcataytytcagtycc

SEQ ID NO: 8117 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (2)..(2): base is a locked nucleic acid
  modified_base (8)..(8): base is a locked nucleic acid
  modified_base (9)..(9): base is a locked nucleic acid
ygcataytytcagtycc

SEQ ID NO: 8118 - DNA, 17 bp, Artificial Sequence
  Oligonucleotide probe
  misc_binding (1)..(17): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
ygcataytytcagtycc

SEQ ID NO: 8119 - DNA, 15 bp, Artificial Sequence
  Oligonucleotide probe
  misc_binding (1)..(15): Hybridization probe for the specific detection of mutant HIV-1 at codon 116 of the reverse transcriptase gene.
ygcataytytcagty

SEQ ID NO: 8120 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (9)..(9): base is a locked nucleic acid
ygcataytytcagty

SEQ ID NO: 8121 - DNA, 16 bp, Artificial Sequence
  Oligonucleotide probe
  misc_binding (1)..(16): Hybridization probe for the specific detection of mutant HIV-1 at codon 116 of the reverse transcriptase gene.
ygcataytytcagtyc

SEQ ID NO: 8122 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (11)..(11): base is a locked nucleic acid
ygcataytytcagty

SEQ ID NO: 8123 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (8)..(8): base is a locked nucleic acid
ygcataytytcagty

SEQ ID NO: 8124 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (2)..(2): base is a locked nucleic acid
ygcataytytcagty

SEQ ID NO: 8125 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (3)..(3): base is a locked nucleic acid
ygcataytytcagty

SEQ ID NO: 8126 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (7)..(7): base is a locked nucleic acid
ygcataytytcagty

SEQ ID NO: 8127 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (10)..(10): base is a locked nucleic acid
ygcataytytcagty

SEQ ID NO: 8128 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (13)..(13): base is a locked nucleic acid
ygcataytytcagty

SEQ ID NO: 8129 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (12)..(12): base is a locked nucleic acid
ygcataytytcagty

SEQ ID NO: 8130 - DNA, 16 bp, Artificial Sequence
  Oligonucleotide probe
  misc_binding (1)..(16): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
ygcataytytcagtyc

SEQ ID NO: 8131 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (4)..(4): base is a locked nucleic acid
  modified_base (8)..(8): base is a locked nucleic acid
  modified_base (9)..(9): base is a locked nucleic acid
ygcataytytcagty

SEQ ID NO: 8132 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (3)..(3): base is a locked nucleic acid
  modified_base (8)..(8): base is a locked nucleic acid
  modified_base (9)..(9): base is a locked nucleic acid
ygcataytytcagty

SEQ ID NO: 8133 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (6)..(6): base is a locked nucleic acid
  modified_base (8)..(8): base is a locked nucleic acid
  modified_base (9)..(9): base is a locked nucleic acid
ygcataytytcagty

SEQ ID NO: 8134 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (2)..(2): base is a locked nucleic acid
  modified_base (8)..(8): base is a locked nucleic acid
  modified_base (9)..(9): base is a locked nucleic acid
ygcataytytcagty

SEQ ID NO: 8135 - DNA, 15 bp, Artificial Sequence
  Oligonucleotide probe
  misc_binding (1)..(15): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
ygcataytytcagty

SEQ ID NO: 8136 - DNA, 14 bp, Artificial Sequence
  Oligonucleotide probe
  misc_binding (1)..(14): Hybridization probe for the specific detection of mutant HIV-1 at codon 116 of the reverse transcriptase gene.
ygcataytytcagt

SEQ ID NO: 8137 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (9)..(9): base is a locked nucleic acid
ygcataytytcag

SEQ ID NO: 8138 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (11)..(11): base is a locked nucleic acid
ygcataytytcag

SEQ ID NO: 8139 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (8)..(8): base is a locked nucleic acid
ygcataytytcag

SEQ ID NO: 8140 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (2)..(2): base is a locked nucleic acid
ygcataytytcag

SEQ ID NO: 8141 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (3)..(3): base is a locked nucleic acid
ygcataytytcag

SEQ ID NO: 8142 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (7)..(7): base is a locked nucleic acid
ygcataytytcag

SEQ ID NO: 8143 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (10)..(10): base is a locked nucleic acid
ygcataytytcag

SEQ ID NO: 8144 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (13)..(13): base is a locked nucleic acid
ygcataytytcag

SEQ ID NO: 8145 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
  modified_base (12)..(12): base is a locked nucleic acid
ygcataytytcag

SEQ ID NO: 8146 - DNA, 14 bp, Artificial Sequence
  Oligonucleotide probe
  misc_binding (1)..(14): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
ygcataytytcagt

SEQ ID NO: 8147 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (4)..(4): base is a locked nucleic acid
  modified_base (8)..(8): base is a locked nucleic acid
  modified_base (9)..(9): base is a locked nucleic acid
ygcataytytcag

SEQ ID NO: 8148 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (3)..(3): base is a locked nucleic acid
  modified_base (8)..(8): base is a locked nucleic acid
  modified_base (9)..(9): base is a locked nucleic acid
ygcataytytcag

SEQ ID NO: 8149 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (6)..(6): base is a locked nucleic acid
  modified_base (8)..(8): base is a locked nucleic acid
  modified_base (9)..(9): base is a locked nucleic acid
ygcataytytcag

SEQ ID NO: 8150 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (2)..(2): base is a locked nucleic acid
  modified_base (8)..(8): base is a locked nucleic acid
  modified_base (9)..(9): base is a locked nucleic acid
ygcataytytcag

SEQ ID NO: 8151 - DNA, 13 bp, Artificial Sequence
  Oligonucleotide probe
  misc_binding (1)..(13): Hybridization probe for the specific detection of mutant HIV-1 at codon 116 of the reverse transcriptase gene.
  modified_base (8)..(8): base is a locked nucleic acid
  modified_base (9)..(9): base is a locked nucleic acid
ygcataytytcag

SEQ ID NO: 8152 - DNA, 15 bp, Artificial Sequence
  Oligonucleotide probe
  misc_binding (1)..(15): Hybridization probe for the specific detection of mutant HIV-1 at codon 116 of the reverse transcriptase gene.
aactgaraaatatgc

SEQ ID NO: 8153 - DNA, 18 bp, Artificial Sequence
  Oligonucleotide probe
  misc_binding (1)..(18): Hybridization probe for the specific detection of mutant HIV-1 at codon 116 of the reverse transcriptase gene.
aygcataytytcagtycc

SEQ ID NO: 8154 - DNA, 17 bp, Artificial Sequence
  Oligonucleotide probe
  misc_binding (1)..(17): Hybridization probe for the specific detection of mutant HIV-1 at codon 116 of the reverse transcriptase gene.
ygcataytytcagtycc

SEQ ID NO: 8155 - DNA, 15 bp, Artificial Sequence
  Oligonucleotide probe
  misc_binding (1)..(15): Hybridization probe for the specific detection of mutant HIV-1 at codon 116 of the reverse transcriptase gene.
ygcataytytcagty

SEQ ID NO: 8156 - DNA, 13 bp, Artificial Sequence
  Oligonucleotide probe
  misc_binding (1)..(13): Hybridization probe for the specific detection of mutant HIV-1 at codon 116 of the reverse transcriptase gene.
ygcataytytcag

SEQ ID NO: 8157 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (10)..(10): base is a locked nucleic acid
tayttytcatyccyttab

SEQ ID NO: 8158 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (12)..(12): base is a locked nucleic acid
tayttytcatyccyttab

SEQ ID NO: 8159 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (14)..(14): base is a locked nucleic acid
tayttytcatyccyttab

SEQ ID NO: 8160 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (18)..(18): base is a locked nucleic acid
tayttytcatyccyttab

SEQ ID NO: 8161 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (2)..(2): base is a locked nucleic acid
tayttytcatyccyttab

SEQ ID NO: 8162 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (9)..(9): base is a locked nucleic acid
tayttytcatyccyttab

SEQ ID NO: 8163 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (4)..(4): base is a locked nucleic acid
tayttytcatyccyttab

SEQ ID NO: 8164 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (7)..(7): base is a locked nucleic acid
tayttytcatyccyttab

SEQ ID NO: 8165 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (9)..(9): base is a locked nucleic acid
  modified_base (10)..(10): base is a locked nucleic acid
  modified_base (15)..(15): base is a locked nucleic acid
tayttytcatyccyttab

SEQ ID NO: 8166 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (9)..(9): base is a locked nucleic acid
  modified_base (10)..(10): base is a locked nucleic acid
  modified_base (14)..(14): base is a locked nucleic acid
tayttytcatyccyttab

SEQ ID NO: 8167 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (9)..(9): base is a locked nucleic acid
  modified_base (10)..(10): base is a locked nucleic acid
  modified_base (13)..(13): base is a locked nucleic acid
tayttytcatyccyttab

SEQ ID NO: 8168 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (9)..(9): base is a locked nucleic acid
  modified_base (10)..(10): base is a locked nucleic acid
  modified_base (11)..(11): base is a locked nucleic acid
tayttytcatyccyttab

SEQ ID NO: 8169 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (2)..(2): base is a locked nucleic acid
  modified_base (9)..(9): base is a locked nucleic acid
  modified_base (10)..(10): base is a locked nucleic acid
tayttytcatyccyttab

SEQ ID NO: 8170 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (6)..(6): base is a locked nucleic acid
  modified_base (9)..(9): base is a locked nucleic acid
  modified_base (10)..(10): base is a locked nucleic acid
tayttytcatyccyttab

SEQ ID NO: 8171 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (3)..(3): base is a locked nucleic acid
  modified_base (9)..(9): base is a locked nucleic acid
  modified_base (10)..(10): base is a locked nucleic acid
tayttytcatyccyttab

SEQ ID NO: 8172 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (5)..(5): base is a locked nucleic acid
  modified_base (9)..(9): base is a locked nucleic acid
  modified_base (10)..(10): base is a locked nucleic acid
tayttytcatyccyttab

SEQ ID NO: 8173 - DNA, 18 bp, Artificial Sequence
  Oligonucleotide probe
  misc_binding (1)..(18): Hybridization probe for the specific detection of mutant HIV-1 at codon 118 of the reverse transcriptase gene.
  modified_base (9)..(9): base is a locked nucleic acid
  modified_base (10)..(10): base is a locked nucleic acid
tayttytcatyccyttab

SEQ ID NO: 8174 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (9)..(9): base is a locked nucleic acid
ayttytcatyccyttab

SEQ ID NO: 8175 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (11)..(11): base is a locked nucleic acid
ayttytcatyccyttab

SEQ ID NO: 8176 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (13)..(13): base is a locked nucleic acid
ayttytcatyccyttab

SEQ ID NO: 8177 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (17)..(17): base is a locked nucleic acid
ayttytcatyccyttab

SEQ ID NO: 8178 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (1)..(1): base is a locked nucleic acid
ayttytcatyccyttab

SEQ ID NO: 8179 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (8)..(8): base is a locked nucleic acid
ayttytcatyccyttab

SEQ ID NO: 8180 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (3)..(3): base is a locked nucleic acid
ayttytcatyccyttab

SEQ ID NO: 8181 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (6)..(6): base is a locked nucleic acid
ayttytcatyccyttab

SEQ ID NO: 8182 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (14)..(14): base is a locked nucleic acid
ayttytcatyccyttab

SEQ ID NO: 8183 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (13)..(13): base is a locked nucleic acid
ayttytcatyccyttab

SEQ ID NO: 8184 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (12)..(12): base is a locked nucleic acid
ayttytcatyccyttab

SEQ ID NO: 8185 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (10)..(10): base is a locked nucleic acid
ayttytcatyccyttab

SEQ ID NO: 8186 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (1)..(1): base is a locked nucleic acid
  modified_base (8)..(8): base is a locked nucleic acid
  modified_base (9)..(9): base is a locked nucleic acid
ayttytcatyccyttab

SEQ ID NO: 8187 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (5)..(5): base is a locked nucleic acid
  modified_base (8)..(8): base is a locked nucleic acid
  modified_base (9)..(9): base is a locked nucleic acid
ayttytcatyccyttab

SEQ ID NO: 8188 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (2)..(2): base is a locked nucleic acid
  modified_base (8)..(8): base is a locked nucleic acid
  modified_base (9)..(9): base is a locked nucleic acid
ayttytcatyccyttab

SEQ ID NO: 8189 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (4)..(4): base is a locked nucleic acid
  modified_base (8)..(8): base is a locked nucleic acid
  modified_base (9)..(9): base is a locked nucleic acid
ayttytcatyccyttab

SEQ ID NO: 8190 - DNA, 17 bp, Artificial Sequence
  Oligonucleotide probe
  misc_binding (1)..(17): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
ayttytcatyccyttab

SEQ ID NO: 8191 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (9)..(9): base is a locked nucleic acid
ayttytcatyccytt

SEQ ID NO: 8192 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (11)..(11): base is a locked nucleic acid
ayttytcatyccytt

SEQ ID NO: 8193 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (13)..(13): base is a locked nucleic acid
ayttytcatyccytt

SEQ ID NO: 8194 - DNA, 16 bp, Artificial Sequence
  Oligonucleotide probe
  misc_binding (1)..(16): Hybridization probe for the specific detection of mutant HIV-1 at codon 118 of the reverse transcriptase gene.
ayttytcatyccytta

SEQ ID NO: 8195 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (1)..(1): base is a locked nucleic acid
ayttytcatyccytt

SEQ ID NO: 8196 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (8)..(8): base is a locked nucleic acid
ayttytcatyccytt

SEQ ID NO: 8197 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (3)..(3): base is a locked nucleic acid
ayttytcatyccytt

SEQ ID NO: 8198 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (6)..(6): base is a locked nucleic acid
ayttytcatyccytt

SEQ ID NO: 8199 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (14)..(14): base is a locked nucleic acid
ayttytcatyccytt

SEQ ID NO: 8200 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (13)..(13): base is a locked nucleic acid
ayttytcatyccytt

SEQ ID NO: 8201 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (12)..(12): base is a locked nucleic acid
ayttytcatyccytt

SEQ ID NO: 8202 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (10)..(10): base is a locked nucleic acid
ayttytcatyccytt

SEQ ID NO: 8203 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (1)..(1): base is a locked nucleic acid
  modified_base (8)..(8): base is a locked nucleic acid
  modified_base (9)..(9): base is a locked nucleic acid
ayttytcatyccytt

SEQ ID NO: 8204 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (5)..(5): base is a locked nucleic acid
  modified_base (8)..(8): base is a locked nucleic acid
  modified_base (9)..(9): base is a locked nucleic acid
ayttytcatyccytt

SEQ ID NO: 8205 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (2)..(2): base is a locked nucleic acid
  modified_base (8)..(8): base is a locked nucleic acid
  modified_base (9)..(9): base is a locked nucleic acid
ayttytcatyccytt

SEQ ID NO: 8206 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (4)..(4): base is a locked nucleic acid
  modified_base (8)..(8): base is a locked nucleic acid
  modified_base (9)..(9): base is a locked nucleic acid
ayttytcatyccytt

SEQ ID NO: 8207 - DNA, 15 bp, Artificial Sequence
  Oligonucleotide probe
  misc_binding (1)..(15): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
ayttytcatyccytt

SEQ ID NO: 8208 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (9)..(9): base is a locked nucleic acid
ayttytcatyccy

SEQ ID NO: 8209 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (11)..(11): base is a locked nucleic acid
ayttytcatyccy

SEQ ID NO: 8210 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (13)..(13): base is a locked nucleic acid
ayttytcatyccy

SEQ ID NO: 8211 - DNA, 14 bp, Artificial Sequence
  Oligonucleotide probe
  misc_binding (1)..(14): Hybridization probe for the specific detection of mutant HIV-1 at codon 118 of the reverse transcriptase gene.
ayttytcatyccyt

SEQ ID NO: 8212 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (1)..(1): base is a locked nucleic acid
ayttytcatyccy

SEQ ID NO: 8213 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (8)..(8): base is a locked nucleic acid
ayttytcatyccy

SEQ ID NO: 8214 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (3)..(3): base is a locked nucleic acid
ayttytcatyccy

SEQ ID NO: 8215 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (6)..(6): base is a locked nucleic acid
ayttytcatyccy

SEQ ID NO: 8216 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
ayttytcatyccy

SEQ ID NO: 8217 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (13)..(13): base is a locked nucleic acid
ayttytcatyccy

SEQ ID NO: 8218 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (12)..(12): base is a locked nucleic acid
ayttytcatyccy

SEQ ID NO: 8219 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
  modified_base (10)..(10): base is a locked nucleic acid
ayttytcatyccy

SEQ ID NO: 8220 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (1)..(1): base is a locked nucleic acid
  modified_base (8)..(8): base is a locked nucleic acid
  modified_base (9)..(9): base is a locked nucleic acid
ayttytcatyccy

SEQ ID NO: 8221 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (5)..(5): base is a locked nucleic acid
  modified_base (8)..(8): base is a locked nucleic acid
  modified_base (9)..(9): base is a locked nucleic acid
ayttytcatyccy

SEQ ID NO: 8222 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (2)..(2): base is a locked nucleic acid
  modified_base (8)..(8): base is a locked nucleic acid
  modified_base (9)..(9): base is a locked nucleic acid
ayttytcatyccy

SEQ ID NO: 8223 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (4)..(4): base is a locked nucleic acid
  modified_base (8)..(8): base is a locked nucleic acid
  modified_base (9)..(9): base is a locked nucleic acid
ayttytcatyccy

SEQ ID NO: 8224 - DNA, 13 bp, Artificial Sequence
  Oligonucleotide probe
  misc_binding (1)..(13): Hybridization probe for the specific detection of mutant HIV-1 at codon 118 of the reverse transcriptase gene.
  modified_base (8)..(8): base is a locked nucleic acid
  modified_base (9)..(9): base is a locked nucleic acid
ayttytcatyccy

SEQ ID NO: 8225 - DNA, 15 bp, Artificial Sequence
  Oligonucleotide probe
  misc_binding (1)..(15): Hybridization probe for the specific detection of mutant HIV-1 at codon 118 of the reverse transcriptase gene.
tttttcaathccttt

SEQ ID NO: 8226 - DNA, 18 bp, Artificial Sequence
  Oligonucleotide probe
  misc_binding (1)..(18): Hybridization probe for the specific detection of mutant HIV-1 at codon 118 of the reverse transcriptase gene.
tayttytcatyccyttab

SEQ ID NO: 8227 - DNA, 17 bp, Artificial Sequence
  Oligonucleotide probe
  misc_binding (1)..(17): Hybridization probe for the specific detection of mutant HIV-1 at codon 118 of the reverse transcriptase gene.
ayttytcatyccyttab

SEQ ID NO: 8228 - DNA, 15 bp, Artificial Sequence
  Oligonucleotide probe
  misc_binding (1)..(15): Hybridization probe for the specific detection of mutant HIV-1 at codon 118 of the reverse transcriptase gene.
ayttytcatyccytt

SEQ ID NO: 8229 - DNA, 13 bp, Artificial Sequence
  Oligonucleotide probe
  misc_binding (1)..(13): Hybridization probe for the specific detection of mutant HIV-1 at codon 118 of the reverse transcriptase gene.
ayttytcatyccy

SEQ ID NO: 8230 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (11)..(11): base is a locked nucleic acid
ryaaayaataracaccag

SEQ ID NO: 8231 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (12)..(12): base is a locked nucleic acid
yaaayaatgracaccagg

SEQ ID NO: 8232 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (15)..(15): base is a locked nucleic acid
yaaayaatgracaccagg

SEQ ID NO: 8233 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (14)..(14): base is a locked nucleic acid
ryaaayaataracaccag

SEQ ID NO: 8234 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (13)..(13): base is a locked nucleic acid
ryaaayaataracaccag

SEQ ID NO: 8235 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (14)..(14): base is a locked nucleic acid
yaaayaatgracaccagg

SEQ ID NO: 8236 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (13)..(13): base is a locked nucleic acid
yaaayaatgracaccagg

SEQ ID NO: 8237 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (15)..(15): base is a locked nucleic acid
ryaaayaataracaccag

SEQ ID NO: 8238 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (17)..(17): base is a locked nucleic acid
ryaaayaataracaccag

SEQ ID NO: 8239 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (16)..(16): base is a locked nucleic acid
yaaayaatgracaccagg

SEQ ID NO: 8240 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (10)..(10): base is a locked nucleic acid
ryaaayaataracaccag

SEQ ID NO: 8241 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (18)..(18): base is a locked nucleic acid
yaaayaatgracaccagg

SEQ ID NO: 8242 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (16)..(16): base is a locked nucleic acid
ryaaayaataracaccag

SEQ ID NO: 8243 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
ryaaayaataracaccag

SEQ ID NO: 8244 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (3)..(3): base is a locked nucleic acid
yaaayaatgracaccagg

SEQ ID NO: 8245 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (4)..(4): base is a locked nucleic acid
yaaayaatgracaccagg

SEQ ID NO: 8246 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (4)..(4): base is a locked nucleic acid
ryaaayaataracaccag

SEQ ID NO: 8247 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (8)..(8): base is a locked nucleic acid
ryaaayaataracaccag

SEQ ID NO: 8248 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
yaaayaatgracaccagg

SEQ ID NO: 8249 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (5)..(5): base is a locked nucleic acid
ryaaayaataracaccag

SEQ ID NO: 8250 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (5)..(5): base is a locked nucleic acid
yaaayaatgracaccagg

SEQ ID NO: 8251 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (6)..(6): base is a locked nucleic acid
ryaaayaataracaccag

SEQ ID NO: 8252 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (2)..(2): base is a locked nucleic acid
yaaayaatgracaccagg

SEQ ID NO: 8253 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (16)..(16): base is a locked nucleic acid
ryaaayaataracaccag

SEQ ID NO: 8254 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (12)..(12): base is a locked nucleic acid
yaaayaatgracaccagg

SEQ ID NO: 8255 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (18)..(18): base is a locked nucleic acid
yaaayaatgracaccagg

SEQ ID NO: 8256 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (15)..(15): base is a locked nucleic acid
ryaaayaataracaccag

SEQ ID NO: 8257 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (14)..(14): base is a locked nucleic acid
yaaayaatgracaccagg

SEQ ID NO: 8258 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (14)..(14): base is a locked nucleic acid
ryaaayaataracaccag

SEQ ID NO: 8259 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (11)..(11): base is a locked nucleic acid
ryaaayaataracaccag

SEQ ID NO: 8260 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (11)..(11): base is a locked nucleic acid
yaaayaatgracaccagg

SEQ ID NO: 8261 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (13)..(13): base is a locked nucleic acid
ryaaayaataracaccag

SEQ ID NO: 8262 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (15)..(15): base is a locked nucleic acid
yaaayaatgracaccagg

SEQ ID NO: 8263 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
  modified_base (17)..(17): base is a locked nucleic acid
ryaaayaataracaccag

SEQ ID NO: 8264 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (2)..(2): base is a locked nucleic acid
  modified_base (9)..(9): base is a locked nucleic acid
  modified_base (10)..(10): base is a locked nucleic acid
ryaaayaataracaccag

SEQ ID NO: 8265 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (6)..(6): base is a locked nucleic acid
  modified_base (9)..(9): base is a locked nucleic acid
  modified_base (10)..(10): base is a locked nucleic acid
yaaayaatgracaccagg

SEQ ID NO: 8266 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (6)..(6): base is a locked nucleic acid
  modified_base (9)..(9): base is a locked nucleic acid
  modified_base (10)..(10): base is a locked nucleic acid
ryaaayaataracaccag

SEQ ID NO: 8267 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (7)..(7): base is a locked nucleic acid
  modified_base (9)..(9): base is a locked nucleic acid
  modified_base (10)..(10): base is a locked nucleic acid
ryaaayaataracaccag

SEQ ID NO: 8268 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
yaaayaatgracaccagg

SEQ ID NO: 8269 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (3)..(3): base is a locked nucleic acid
  modified_base (9)..(9): base is a locked nucleic acid
  modified_base (10)..(10): base is a locked nucleic acid
ryaaayaataracaccag

SEQ ID NO: 8270 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (3)..(3): base is a locked nucleic acid
  modified_base (9)..(9): base is a locked nucleic acid
  modified_base (10)..(10): base is a locked nucleic acid
yaaayaatgracaccagg

SEQ ID NO: 8271 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (4)..(4): base is a locked nucleic acid
  modified_base (9)..(9): base is a locked nucleic acid
  modified_base (10)..(10): base is a locked nucleic acid
yaaayaatgracaccagg

SEQ ID NO: 8272 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
ryaaayaataracaccag

SEQ ID NO: 8273 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (7)..(7): base is a locked nucleic acid
  modified_base (9)..(9): base is a locked nucleic acid
  modified_base (10)..(10): base is a locked nucleic acid
yaaayaatgracaccagg

SEQ ID NO: 8274 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (5)..(5): base is a locked nucleic acid
  modified_base (9)..(9): base is a locked nucleic acid
  modified_base (10)..(10): base is a locked nucleic acid
ryaaayaataracaccag

SEQ ID NO: 8275 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
ryaaayaataracaccag

SEQ ID NO: 8276 - DNA, 18 bp, Artificial Sequence
  Oligonucleotide probe
  misc_binding (1)..(18): Hybridization probe for the specific detection of mutant HIV-1 at codon 138 of the reverse transcriptase gene.
  modified_base (9)..(9): base is a locked nucleic acid
  modified_base (10)..(10): base is a locked nucleic acid
yaaayaatgracaccagg

SEQ ID NO: 8277 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (10)..(10): base is a locked nucleic acid
yaaayaataracaccag

SEQ ID NO: 8278 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (11)..(11): base is a locked nucleic acid
aaayaatgracaccagg

SEQ ID NO: 8279 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (14)..(14): base is a locked nucleic acid
aaayaatgracaccagg

SEQ ID NO: 8280 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (13)..(13): base is a locked nucleic acid
yaaayaataracaccag

SEQ ID NO: 8281 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (12)..(12): base is a locked nucleic acid
yaaayaataracaccag

SEQ ID NO: 8282 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (13)..(13): base is a locked nucleic acid
aaayaatgracaccagg

SEQ ID NO: 8283 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (12)..(12): base is a locked nucleic acid
aaayaatgracaccagg

SEQ ID NO: 8284 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (14)..(14): base is a locked nucleic acid
yaaayaataracaccag

SEQ ID NO: 8285 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (16)..(16): base is a locked nucleic acid
yaaayaataracaccag

SEQ ID NO: 8286 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (15)..(15): base is a locked nucleic acid
aaayaatgracaccagg

SEQ ID NO: 8287 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (9)..(9): base is a locked nucleic acid
yaaayaataracaccag

SEQ ID NO: 8288 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (17)..(17): base is a locked nucleic acid
aaayaatgracaccagg

SEQ ID NO: 8289 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (15)..(15): base is a locked nucleic acid
yaaayaataracaccag

SEQ ID NO: 8290 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
yaaayaataracaccag

SEQ ID NO: 8291 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (2)..(2): base is a locked nucleic acid
aaayaatgracaccagg

SEQ ID NO: 8292 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (3)..(3): base is a locked nucleic acid
aaayaatgracaccagg

SEQ ID NO: 8293 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (3)..(3): base is a locked nucleic acid
yaaayaataracaccag

SEQ ID NO: 8294 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (7)..(7): base is a locked nucleic acid
yaaayaataracaccag

SEQ ID NO: 8295 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
aaayaatgracaccagg

SEQ ID NO: 8296 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (4)..(4): base is a locked nucleic acid
yaaayaataracaccag

SEQ ID NO: 8297 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (4)..(4): base is a locked nucleic acid
aaayaatgracaccagg

SEQ ID NO: 8298 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (5)..(5): base is a locked nucleic acid
yaaayaataracaccag

SEQ ID NO: 8299 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (1)..(1): base is a locked nucleic acid
aaayaatgracaccagg

SEQ ID NO: 8300 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (15)..(15): base is a locked nucleic acid
yaaayaataracaccag

SEQ ID NO: 8301 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (11)..(11): base is a locked nucleic acid
aaayaatgracaccagg

SEQ ID NO: 8302 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (17)..(17): base is a locked nucleic acid
aaayaatgracaccagg

SEQ ID NO: 8303 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (14)..(14): base is a locked nucleic acid
yaaayaataracaccag

SEQ ID NO: 8304 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (13)..(13): base is a locked nucleic acid
aaayaatgracaccagg

SEQ ID NO: 8305 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (13)..(13): base is a locked nucleic acid
yaaayaataracaccag

SEQ ID NO: 8306 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
yaaayaataracaccag

SEQ ID NO: 8307 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
aaayaatgracaccagg

SEQ ID NO: 8308 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (12)..(12): base is a locked nucleic acid
yaaayaataracaccag

SEQ ID NO: 8309 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (14)..(14): base is a locked nucleic acid
aaayaatgracaccagg

SEQ ID NO: 8310 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (16)..(16): base is a locked nucleic acid
yaaayaataracaccag

SEQ ID NO: 8311 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (1)..(1): base is a locked nucleic acid
  modified_base (8)..(8): base is a locked nucleic acid
  modified_base (9)..(9): base is a locked nucleic acid
yaaayaataracaccag

SEQ ID NO: 8312 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (5)..(5): base is a locked nucleic acid
  modified_base (8)..(8): base is a locked nucleic acid
  modified_base (9)..(9): base is a locked nucleic acid
aaayaatgracaccagg

SEQ ID NO: 8313 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (5)..(5): base is a locked nucleic acid
  modified_base (8)..(8): base is a locked nucleic acid
  modified_base (9)..(9): base is a locked nucleic acid
yaaayaataracaccag

SEQ ID NO: 8314 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (6)..(6): base is a locked nucleic acid
  modified_base (8)..(8): base is a locked nucleic acid
  modified_base (9)..(9): base is a locked nucleic acid
yaaayaataracaccag

SEQ ID NO: 8315 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (7)..(7): base is a locked nucleic acid
  modified_base (8)..(8): base is a locked nucleic acid
  modified_base (9)..(9): base is a locked nucleic acid
aaayaatgracaccagg

SEQ ID NO: 8316 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (2)..(2): base is a locked nucleic acid
  modified_base (8)..(8): base is a locked nucleic acid
  modified_base (9)..(9): base is a locked nucleic acid
yaaayaataracaccag

SEQ ID NO: 8317 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (2)..(2): base is a locked nucleic acid
  modified_base (8)..(8): base is a locked nucleic acid
  modified_base (9)..(9): base is a locked nucleic acid
aaayaatgracaccagg

SEQ ID NO: 8318 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (3)..(3): base is a locked nucleic acid
  modified_base (8)..(8): base is a locked nucleic acid
  modified_base (9)..(9): base is a locked nucleic acid
aaayaatgracaccagg

SEQ ID NO: 8319 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (7)..(7): base is a locked nucleic acid
  modified_base (8)..(8): base is a locked nucleic acid
  modified_base (9)..(9): base is a locked nucleic acid
yaaayaataracaccag

SEQ ID NO: 8320 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (6)..(6): base is a locked nucleic acid
  modified_base (8)..(8): base is a locked nucleic acid
  modified_base (9)..(9): base is a locked nucleic acid
aaayaatgracaccagg

SEQ ID NO: 8321 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (4)..(4): base is a locked nucleic acid
  modified_base (8)..(8): base is a locked nucleic acid
  modified_base (9)..(9): base is a locked nucleic acid
yaaayaataracaccag

SEQ ID NO: 8322 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
yaaayaataracaccag

SEQ ID NO: 8323 - DNA, 17 bp, Artificial Sequence
  Oligonucleotide probe
  misc_binding (1)..(17): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
aaayaatgracaccagg

SEQ ID NO: 8324 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (10)..(10): base is a locked nucleic acid
yaaayaataracacc

SEQ ID NO: 8325 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (11)..(11): base is a locked nucleic acid
aaayaatgracacca

SEQ ID NO: 8326 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (14)..(14): base is a locked nucleic acid
aaayaatgracacca

SEQ ID NO: 8327 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (13)..(13): base is a locked nucleic acid
yaaayaataracacc

SEQ ID NO: 8328 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (12)..(12): base is a locked nucleic acid
yaaayaataracacc

SEQ ID NO: 8329 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (13)..(13): base is a locked nucleic acid
aaayaatgracacca

SEQ ID NO: 8330 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (12)..(12): base is a locked nucleic acid
aaayaatgracacca

SEQ ID NO: 8331 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (14)..(14): base is a locked nucleic acid
yaaayaataracacc

SEQ ID NO: 8332 - DNA, 15 bp, Artificial Sequence
  Oligonucleotide probe
  misc_binding (1)..(15): Hybridization probe for the specific detection of mutant HIV-1 at codon 138 of the reverse transcriptase gene.
yaaayaataracacc

SEQ ID NO: 8333 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (15)..(15): base is a locked nucleic acid
aaayaatgracacca

SEQ ID NO: 8334 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (9)..(9): base is a locked nucleic acid
yaaayaataracacc

SEQ ID NO: 8335 - DNA, 16 bp, Artificial Sequence
  Oligonucleotide probe
  misc_binding (1)..(16): Hybridization probe for the specific detection of mutant HIV-1 at codon 138 of the reverse transcriptase gene.
aaayaatgracaccag

SEQ ID NO: 8336 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (15)..(15): base is a locked nucleic acid
yaaayaataracacc

SEQ ID NO: 8337 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
yaaayaataracacc

SEQ ID NO: 8338 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (2)..(2): base is a locked nucleic acid
aaayaatgracacca

SEQ ID NO: 8339 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (3)..(3): base is a locked nucleic acid
aaayaatgracacca

SEQ ID NO: 8340 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (3)..(3): base is a locked nucleic acid
yaaayaataracacc

SEQ ID NO: 8341 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (7)..(7): base is a locked nucleic acid
yaaayaataracacc

SEQ ID NO: 8342 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
aaayaatgracacca

SEQ ID NO: 8343 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (4)..(4): base is a locked nucleic acid
yaaayaataracacc

SEQ ID NO: 8344 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (4)..(4): base is a locked nucleic acid
aaayaatgracacca

SEQ ID NO: 8345 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (5)..(5): base is a locked nucleic acid
yaaayaataracacc

SEQ ID NO: 8346 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (1)..(1): base is a locked nucleic acid
aaayaatgracacca

SEQ ID NO: 8347 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (15)..(15): base is a locked nucleic acid
yaaayaataracacc

SEQ ID NO: 8348 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (11)..(11): base is a locked nucleic acid
aaayaatgracacca

SEQ ID NO: 8349 - DNA, 16 bp, Artificial Sequence
  Oligonucleotide probe
  misc_binding (1)..(16): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
aaayaatgracaccag

SEQ ID NO: 8350 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (14)..(14): base is a locked nucleic acid
yaaayaataracacc

SEQ ID NO: 8351 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (13)..(13): base is a locked nucleic acid
aaayaatgracacca

SEQ ID NO: 8352 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (13)..(13): base is a locked nucleic acid
yaaayaataracacc

SEQ ID NO: 8353 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
yaaayaataracacc

SEQ ID NO: 8354 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
aaayaatgracacca

SEQ ID NO: 8355 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (12)..(12): base is a locked nucleic acid
yaaayaataracacc

SEQ ID NO: 8356 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (14)..(14): base is a locked nucleic acid
aaayaatgracacca

SEQ ID NO: 8357 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
yaaayaataracacc

SEQ ID NO: 8358 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (1)..(1): base is a locked nucleic acid
  modified_base (8)..(8): base is a locked nucleic acid
  modified_base (9)..(9): base is a locked nucleic acid
yaaayaataracacc

SEQ ID NO: 8359 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (5)..(5): base is a locked nucleic acid
  modified_base (8)..(8): base is a locked nucleic acid
  modified_base (9)..(9): base is a locked nucleic acid
aaayaatgracacca

SEQ ID NO: 8360 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (5)..(5): base is a locked nucleic acid
  modified_base (8)..(8): base is a locked nucleic acid
  modified_base (9)..(9): base is a locked nucleic acid
yaaayaataracacc

SEQ ID NO: 8361 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (6)..(6): base is a locked nucleic acid
  modified_base (8)..(8): base is a locked nucleic acid
  modified_base (9)..(9): base is a locked nucleic acid
yaaayaataracacc

SEQ ID NO: 8362 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (7)..(7): base is a locked nucleic acid
  modified_base (8)..(8): base is a locked nucleic acid
  modified_base (9)..(9): base is a locked nucleic acid
aaayaatgracacca

SEQ ID NO: 8363 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (2)..(2): base is a locked nucleic acid
  modified_base (8)..(8): base is a locked nucleic acid
  modified_base (9)..(9): base is a locked nucleic acid
yaaayaataracacc

SEQ ID NO: 8364 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (2)..(2): base is a locked nucleic acid
  modified_base (8)..(8): base is a locked nucleic acid
  modified_base (9)..(9): base is a locked nucleic acid
aaayaatgracacca

SEQ ID NO: 8365 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (3)..(3): base is a locked nucleic acid
  modified_base (8)..(8): base is a locked nucleic acid
  modified_base (9)..(9): base is a locked nucleic acid
aaayaatgracacca

SEQ ID NO: 8366 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (7)..(7): base is a locked nucleic acid
  modified_base (8)..(8): base is a locked nucleic acid
  modified_base (9)..(9): base is a locked nucleic acid
yaaayaataracacc

SEQ ID NO: 8367 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (6)..(6): base is a locked nucleic acid
  modified_base (8)..(8): base is a locked nucleic acid
  modified_base (9)..(9): base is a locked nucleic acid
aaayaatgracacca

SEQ ID NO: 8368 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (4)..(4): base is a locked nucleic acid
  modified_base (8)..(8): base is a locked nucleic acid
  modified_base (9)..(9): base is a locked nucleic acid
yaaayaataracacc

SEQ ID NO: 8369 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
yaaayaataracacc

SEQ ID NO: 8370 - DNA, 15 bp, Artificial Sequence
  Oligonucleotide probe
  misc_binding (1)..(15): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
aaayaatgracacca

SEQ ID NO: 8371 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (10)..(10): base is a locked nucleic acid
yaaayaataraca

SEQ ID NO: 8372 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (11)..(11): base is a locked nucleic acid
aaayaatgracac

SEQ ID NO: 8373 - DNA, 13 bp, Artificial Sequence
  Oligonucleotide probe
  misc_binding (1)..(13): Hybridization probe for the specific detection of mutant HIV-1 at codon 138 of the reverse transcriptase gene.
aaayaatgracac

SEQ ID NO: 8374 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (13)..(13): base is a locked nucleic acid
yaaayaataraca

SEQ ID NO: 8375 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (12)..(12): base is a locked nucleic acid
yaaayaataraca

SEQ ID NO: 8376 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (13)..(13): base is a locked nucleic acid
aaayaatgracac

SEQ ID NO: 8377 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (12)..(12): base is a locked nucleic acid
aaayaatgracac

SEQ ID NO: 8378 - DNA, 13 bp, Artificial Sequence
  Oligonucleotide probe
  misc_binding (1)..(13): Hybridization probe for the specific detection of mutant HIV-1 at codon 138 of the reverse transcriptase gene.
yaaayaataraca

SEQ ID NO: 8379 - DNA, 14 bp, Artificial Sequence
  Oligonucleotide probe
  misc_binding (1)..(14): Hybridization probe for the specific detection of mutant HIV-1 at codon 138 of the reverse transcriptase gene.
yaaayaataracac

SEQ ID NO: 8380 - DNA, 14 bp, Artificial Sequence
  Oligonucleotide probe
  misc_binding (1)..(14): Hybridization probe for the specific detection of mutant HIV-1 at codon 138 of the reverse transcriptase gene.
aaayaatgracacc

SEQ ID NO: 8381 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (9)..(9): base is a locked nucleic acid
yaaayaataraca

SEQ ID NO: 8382 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
yaaayaataraca

SEQ ID NO: 8383 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (2)..(2): base is a locked nucleic acid
aaayaatgracac

SEQ ID NO: 8384 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (3)..(3): base is a locked nucleic acid
aaayaatgracac

SEQ ID NO: 8385 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (3)..(3): base is a locked nucleic acid
yaaayaataraca

SEQ ID NO: 8386 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (7)..(7): base is a locked nucleic acid
yaaayaataraca

SEQ ID NO: 8387 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
aaayaatgracac

SEQ ID NO: 8388 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (4)..(4): base is a locked nucleic acid
yaaayaataraca

SEQ ID NO: 8389 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (4)..(4): base is a locked nucleic acid
aaayaatgracac

SEQ ID NO: 8390 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (5)..(5): base is a locked nucleic acid
yaaayaataraca

SEQ ID NO: 8391 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (1)..(1): base is a locked nucleic acid
aaayaatgracac

SEQ ID NO: 8392 - DNA, 14 bp, Artificial Sequence
  Oligonucleotide probe
  misc_binding (1)..(14): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
yaaayaataracac

SEQ ID NO: 8393 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (11)..(11): base is a locked nucleic acid
aaayaatgracac

SEQ ID NO: 8394 - DNA, 14 bp, Artificial Sequence
  Oligonucleotide probe
  misc_binding (1)..(14): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
aaayaatgracacc

SEQ ID NO: 8395 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
yaaayaataraca

SEQ ID NO: 8396 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (13)..(13): base is a locked nucleic acid
aaayaatgracac

SEQ ID NO: 8397 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (13)..(13): base is a locked nucleic acid
yaaayaataraca

SEQ ID NO: 8398 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
yaaayaataraca

SEQ ID NO: 8399 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (10)..(10): base is a locked nucleic acid
aaayaatgracac

SEQ ID NO: 8400 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
  modified_base (12)..(12): base is a locked nucleic acid
yaaayaataraca

SEQ ID NO: 8401 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
aaayaatgracac

SEQ ID NO: 8402 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (1)..(1): base is a locked nucleic acid
  modified_base (8)..(8): base is a locked nucleic acid
  modified_base (9)..(9): base is a locked nucleic acid
yaaayaataraca

SEQ ID NO: 8403 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (5)..(5): base is a locked nucleic acid
  modified_base (8)..(8): base is a locked nucleic acid
  modified_base (9)..(9): base is a locked nucleic acid
aaayaatgracac

SEQ ID NO: 8404 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (5)..(5): base is a locked nucleic acid
  modified_base (8)..(8): base is a locked nucleic acid
  modified_base (9)..(9): base is a locked nucleic acid
yaaayaataraca

SEQ ID NO: 8405 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (6)..(6): base is a locked nucleic acid
  modified_base (8)..(8): base is a locked nucleic acid
  modified_base (9)..(9): base is a locked nucleic acid
yaaayaataraca

SEQ ID NO: 8406 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (7)..(7): base is a locked nucleic acid
  modified_base (8)..(8): base is a locked nucleic acid
  modified_base (9)..(9): base is a locked nucleic acid
aaayaatgracac

SEQ ID NO: 8407 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (2)..(2): base is a locked nucleic acid
  modified_base (8)..(8): base is a locked nucleic acid
  modified_base (9)..(9): base is a locked nucleic acid
yaaayaataraca

SEQ ID NO: 8408 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (2)..(2): base is a locked nucleic acid
  modified_base (8)..(8): base is a locked nucleic acid
  modified_base (9)..(9): base is a locked nucleic acid
aaayaatgracac

SEQ ID NO: 8409 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (3)..(3): base is a locked nucleic acid
  modified_base (8)..(8): base is a locked nucleic acid
  modified_base (9)..(9): base is a locked nucleic acid
aaayaatgracac

SEQ ID NO: 8410 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (7)..(7): base is a locked nucleic acid
  modified_base (8)..(8): base is a locked nucleic acid
  modified_base (9)..(9): base is a locked nucleic acid
yaaayaataraca

SEQ ID NO: 8411 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (6)..(6): base is a locked nucleic acid
  modified_base (8)..(8): base is a locked nucleic acid
  modified_base (9)..(9): base is a locked nucleic acid
aaayaatgracac

SEQ ID NO: 8412 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (4)..(4): base is a locked nucleic acid
  modified_base (8)..(8): base is a locked nucleic acid
  modified_base (9)..(9): base is a locked nucleic acid
yaaayaataraca

SEQ ID NO: 8413 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
yaaayaataraca

SEQ ID NO: 8414 - DNA, 13 bp, Artificial Sequence
  Oligonucleotide probe
  misc_binding (1)..(13): Hybridization probe for the specific detection of mutant HIV-1 at codon 138 of the reverse transcriptase gene.
  modified_base (8)..(8): base is a locked nucleic acid
  modified_base (9)..(9): base is a locked nucleic acid
aaayaatgracac

SEQ ID NO: 8415 - DNA, 15 bp, Artificial Sequence
  Oligonucleotide probe
  misc_binding (1)..(15): Hybridization probe for the specific detection of mutant HIV-1 at codon 138 of the reverse transcriptase gene.
aacaataaracacca

SEQ ID NO: 8416 - DNA, 15 bp, Artificial Sequence
  Oligonucleotide probe
  misc_binding (1)..(15): Hybridization probe for the specific detection of mutant HIV-1 at codon 138 of the reverse transcriptase gene.
aacaatgcracacca

SEQ ID NO: 8417 - DNA, 15 bp, Artificial Sequence
  Oligonucleotide probe
  misc_binding (1)..(15): Hybridization probe for the specific detection of mutant HIV-1 at codon 138 of the reverse transcriptase gene.
aacaatggracacca

SEQ ID NO: 8418 - DNA, 15 bp, Artificial Sequence
  Oligonucleotide probe
  misc_binding (1)..(15): Hybridization probe for the specific detection of mutant HIV-1 at codon 138 of the reverse transcriptase gene.
aacaatcaracacca

SEQ ID NO: 8419 - DNA, 18 bp, Artificial Sequence
  Oligonucleotide probe
  misc_binding (1)..(18): Hybridization probe for the specific detection of mutant HIV-1 at codon 138 of the reverse transcriptase gene.
ryaaayaataracaccag

SEQ ID NO: 8420 - DNA, 18 bp, Artificial Sequence
  Oligonucleotide probe
  misc_binding (1)..(18): Hybridization probe for the specific detection of mutant HIV-1 at codon 138 of the reverse transcriptase gene.
yaaayaatgracaccagg

SEQ ID NO: 8421 - DNA, 17 bp, Artificial Sequence
  Oligonucleotide probe
  misc_binding (1)..(17): Hybridization probe for the specific detection of mutant HIV-1 at codon 138 of the reverse transcriptase gene.
yaaayaataracaccag

SEQ ID NO: 8422 - DNA, 17 bp, Artificial Sequence
  Oligonucleotide probe
  misc_binding (1)..(17): Hybridization probe for the specific detection of mutant HIV-1 at codon 138 of the reverse transcriptase gene.
aaayaatgracaccagg

SEQ ID NO: 8423 - DNA, 15 bp, Artificial Sequence
  Oligonucleotide probe
  misc_binding (1)..(15): Hybridization probe for the specific detection of mutant HIV-1 at codon 138 of the reverse transcriptase gene.
yaaayaataracacc

SEQ ID NO: 8424 - DNA, 15 bp, Artificial Sequence
  Oligonucleotide probe
  misc_binding (1)..(15): Hybridization probe for the specific detection of mutant HIV-1 at codon 138 of the reverse transcriptase gene.
aaayaatgracacca

SEQ ID NO: 8425 - DNA, 13 bp, Artificial Sequence
  Oligonucleotide probe
  misc_binding (1)..(13): Hybridization probe for the specific detection of mutant HIV-1 at codon 138 of the reverse transcriptase gene.
yaaayaataraca

SEQ ID NO: 8426 - DNA, 13 bp, Artificial Sequence
  Oligonucleotide probe
  misc_binding (1)..(13): Hybridization probe for the specific detection of mutant HIV-1 at codon 138 of the reverse transcriptase gene.
aaayaatgracac

SEQ ID NO: 8427 - DNA, 15 bp, Artificial Sequence
  Oligonucleotide probe
  misc_binding (1)..(15): Hybridization probe for the specific detection of mutant HIV-1 at codon 151 of the reverse transcriptase gene.
cttccaatgggatgg

SEQ ID NO: 8428 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (12)..(12): base is a locked nucleic acid
cagavatrrbatytayca

SEQ ID NO: 8429 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (12)..(12): base is a locked nucleic acid
ccagavatrtbatytayc

SEQ ID NO: 8430 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (10)..(10): base is a locked nucleic acid
cagavatrrbatytayca

SEQ ID NO: 8431 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (18)..(18): base is a locked nucleic acid
ccagavatrtbatytayc

SEQ ID NO: 8432 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (13)..(13): base is a locked nucleic acid
cagavatrrbatytayca

SEQ ID NO: 8433 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (17)..(17): base is a locked nucleic acid
ccagavatrtbatytayc

SEQ ID NO: 8434 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (16)..(16): base is a locked nucleic acid
cagavatrrbatytayca

SEQ ID NO: 8435 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (16)..(16): base is a locked nucleic acid
ccagavatrtbatytayc

SEQ ID NO: 8436 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (8)..(8): base is a locked nucleic acid
cagavatrrbatytayca

SEQ ID NO: 8437 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (6)..(6): base is a locked nucleic acid
ccagavatrtbatytayc

SEQ ID NO: 8438 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
cagavatrrbatytayca

SEQ ID NO: 8439 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (7)..(7): base is a locked nucleic acid
ccagavatrtbatytayc

SEQ ID NO: 8440 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (6)..(6): base is a locked nucleic acid
cagavatrrbatytayca

SEQ ID NO: 8441 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (4)..(4): base is a locked nucleic acid
ccagavatrtbatytayc

SEQ ID NO: 8442 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (4)..(4): base is a locked nucleic acid
cagavatrrbatytayca

SEQ ID NO: 8443 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (8)..(8): base is a locked nucleic acid
ccagavatrtbatytayc

SEQ ID NO: 8444 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (18)..(18): base is a locked nucleic acid
cagavatrrbatytayca

SEQ ID NO: 8445 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (17)..(17): base is a locked nucleic acid
ccagavatrtbatytayc

SEQ ID NO: 8446 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (16)..(16): base is a locked nucleic acid
cagavatrrbatytayca

SEQ ID NO: 8447 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (12)..(12): base is a locked nucleic acid
ccagavatrtbatytayc

SEQ ID NO: 8448 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (15)..(15): base is a locked nucleic acid
cagavatrrbatytayca

SEQ ID NO: 8449 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (11)..(11): base is a locked nucleic acid
ccagavatrtbatytayc

SEQ ID NO: 8450 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (12)..(12): base is a locked nucleic acid
cagavatrrbatytayca

SEQ ID NO: 8451 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
  modified_base (14)..(14): base is a locked nucleic acid
ccagavatrtbatytayc

SEQ ID NO: 8452 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (5)..(5): base is a locked nucleic acid
  modified_base (9)..(9): base is a locked nucleic acid
  modified_base (10)..(10): base is a locked nucleic acid
cagavatrrbatytayca

SEQ ID NO: 8453 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (4)..(4): base is a locked nucleic acid
  modified_base (9)..(9): base is a locked nucleic acid
  modified_base (10)..(10): base is a locked nucleic acid
ccagavatrtbatytayc

SEQ ID NO: 8454 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (3)..(3): base is a locked nucleic acid
  modified_base (9)..(9): base is a locked nucleic acid
  modified_base (10)..(10): base is a locked nucleic acid
cagavatrrbatytayca

SEQ ID NO: 8455 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (5)..(5): base is a locked nucleic acid
  modified_base (9)..(9): base is a locked nucleic acid
  modified_base (10)..(10): base is a locked nucleic acid
ccagavatrtbatytayc

SEQ ID NO: 8456 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (6)..(6): base is a locked nucleic acid
  modified_base (9)..(9): base is a locked nucleic acid
  modified_base (10)..(10): base is a locked nucleic acid
cagavatrrbatytayca

SEQ ID NO: 8457 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (7)..(7): base is a locked nucleic acid
  modified_base (9)..(9): base is a locked nucleic acid
  modified_base (10)..(10): base is a locked nucleic acid
ccagavatrtbatytayc

SEQ ID NO: 8458 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (4)..(4): base is a locked nucleic acid
  modified_base (9)..(9): base is a locked nucleic acid
  modified_base (10)..(10): base is a locked nucleic acid
cagavatrrbatytayca

SEQ ID NO: 8459 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (2)..(2): base is a locked nucleic acid
  modified_base (9)..(9): base is a locked nucleic acid
  modified_base (10)..(10): base is a locked nucleic acid
ccagavatrtbatytayc

SEQ ID NO: 8460 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
cagavatrrbatytayca

SEQ ID NO: 8461 - DNA, 18 bp, Artificial Sequence
  Oligonucleotide probe
  misc_binding (1)..(18): Hybridization probe for the specific detection of mutant HIV-1 at codon 179 of the reverse transcriptase gene.
  modified_base (9)..(9): base is a locked nucleic acid
  modified_base (10)..(10): base is a locked nucleic acid
ccagavatrtbatytayc

SEQ ID NO: 8462 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (11)..(11): base is a locked nucleic acid
agavatrrbatytayca

SEQ ID NO: 8463 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (11)..(11): base is a locked nucleic acid
cagavatrtbatytayc

SEQ ID NO: 8464 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (9)..(9): base is a locked nucleic acid
agavatrrbatytayca

SEQ ID NO: 8465 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (17)..(17): base is a locked nucleic acid
cagavatrtbatytayc

SEQ ID NO: 8466 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (12)..(12): base is a locked nucleic acid
agavatrrbatytayca

SEQ ID NO: 8467 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (16)..(16): base is a locked nucleic acid
cagavatrtbatytayc

SEQ ID NO: 8468 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (15)..(15): base is a locked nucleic acid
agavatrrbatytayca

SEQ ID NO: 8469 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (15)..(15): base is a locked nucleic acid
cagavatrtbatytayc

SEQ ID NO: 8470 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (7)..(7): base is a locked nucleic acid
agavatrrbatytayca

SEQ ID NO: 8471 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (5)..(5): base is a locked nucleic acid
cagavatrtbatytayc

SEQ ID NO: 8472 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
agavatrrbatytayca

SEQ ID NO: 8473 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (6)..(6): base is a locked nucleic acid
cagavatrtbatytayc

SEQ ID NO: 8474 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (5)..(5): base is a locked nucleic acid
agavatrrbatytayca

SEQ ID NO: 8475 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (3)..(3): base is a locked nucleic acid
cagavatrtbatytayc

SEQ ID NO: 8476 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (3)..(3): base is a locked nucleic acid
agavatrrbatytayca

SEQ ID NO: 8477 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (7)..(7): base is a locked nucleic acid
cagavatrtbatytayc

SEQ ID NO: 8478 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (17)..(17): base is a locked nucleic acid
agavatrrbatytayca

SEQ ID NO: 8479 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (16)..(16): base is a locked nucleic acid
cagavatrtbatytayc

SEQ ID NO: 8480 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (15)..(15): base is a locked nucleic acid
agavatrrbatytayca

SEQ ID NO: 8481 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (11)..(11): base is a locked nucleic acid
cagavatrtbatytayc

SEQ ID NO: 8482 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (14)..(14): base is a locked nucleic acid
agavatrrbatytayca

SEQ ID NO: 8483 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (10)..(10): base is a locked nucleic acid
cagavatrtbatytayc

SEQ ID NO: 8484 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (11)..(11): base is a locked nucleic acid
agavatrrbatytayca

SEQ ID NO: 8485 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (13)..(13): base is a locked nucleic acid
cagavatrtbatytayc

SEQ ID NO: 8486 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (4)..(4): base is a locked nucleic acid
  modified_base (8)..(8): base is a locked nucleic acid
  modified_base (9)..(9): base is a locked nucleic acid
agavatrrbatytayca

SEQ ID NO: 8487 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (3)..(3): base is a locked nucleic acid
  modified_base (8)..(8): base is a locked nucleic acid
  modified_base (9)..(9): base is a locked nucleic acid
cagavatrtbatytayc

SEQ ID NO: 8488 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (2)..(2): base is a locked nucleic acid
  modified_base (8)..(8): base is a locked nucleic acid
  modified_base (9)..(9): base is a locked nucleic acid
agavatrrbatytayca

SEQ ID NO: 8489 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (4)..(4): base is a locked nucleic acid
  modified_base (8)..(8): base is a locked nucleic acid
  modified_base (9)..(9): base is a locked nucleic acid
cagavatrtbatytayc

SEQ ID NO: 8490 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (5)..(5): base is a locked nucleic acid
  modified_base (8)..(8): base is a locked nucleic acid
  modified_base (9)..(9): base is a locked nucleic acid
agavatrrbatytayca

SEQ ID NO: 8491 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (6)..(6): base is a locked nucleic acid
  modified_base (8)..(8): base is a locked nucleic acid
  modified_base (9)..(9): base is a locked nucleic acid
cagavatrtbatytayc

SEQ ID NO: 8492 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (3)..(3): base is a locked nucleic acid
  modified_base (8)..(8): base is a locked nucleic acid
  modified_base (9)..(9): base is a locked nucleic acid
agavatrrbatytayca

SEQ ID NO: 8493 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (1)..(1): base is a locked nucleic acid
  modified_base (8)..(8): base is a locked nucleic acid
  modified_base (9)..(9): base is a locked nucleic acid
cagavatrtbatytayc

SEQ ID NO: 8494 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
agavatrrbatytayca

SEQ ID NO: 8495 - DNA, 17 bp, Artificial Sequence
  Oligonucleotide probe
  misc_binding (1)..(17): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
cagavatrtbatytayc

SEQ ID NO: 8496 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (11)..(11): base is a locked nucleic acid
agavatrrbatytay

SEQ ID NO: 8497 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (11)..(11): base is a locked nucleic acid
cagavatrtbatyta

SEQ ID NO: 8498 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (9)..(9): base is a locked nucleic acid
agavatrrbatytay

SEQ ID NO: 8499 - DNA, 16 bp, Artificial Sequence
  Oligonucleotide probe
  misc_binding (1)..(16): Hybridization probe for the specific detection of mutant HIV-1 at codon 179 of the reverse transcriptase gene.
cagavatrtbatytay

SEQ ID NO: 8500 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (12)..(12): base is a locked nucleic acid
agavatrrbatytay

SEQ ID NO: 8501 - DNA, 15 bp, Artificial Sequence
  Oligonucleotide probe
  misc_binding (1)..(15): Hybridization probe for the specific detection of mutant HIV-1 at codon 179 of the reverse transcriptase gene.
cagavatrtbatyta

SEQ ID NO: 8502 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (15)..(15): base is a locked nucleic acid
agavatrrbatytay

SEQ ID NO: 8503 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (15)..(15): base is a locked nucleic acid
cagavatrtbatyta

SEQ ID NO: 8504 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (7)..(7): base is a locked nucleic acid
agavatrrbatytay

SEQ ID NO: 8505 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (5)..(5): base is a locked nucleic acid
cagavatrtbatyta

SEQ ID NO: 8506 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
agavatrrbatytay

SEQ ID NO: 8507 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (6)..(6): base is a locked nucleic acid
cagavatrtbatyta

SEQ ID NO: 8508 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (5)..(5): base is a locked nucleic acid
agavatrrbatytay

SEQ ID NO: 8509 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (3)..(3): base is a locked nucleic acid
cagavatrtbatyta

SEQ ID NO: 8510 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (3)..(3): base is a locked nucleic acid
agavatrrbatytay

SEQ ID NO: 8511 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (7)..(7): base is a locked nucleic acid
cagavatrtbatyta

SEQ ID NO: 8512 - DNA, 16 bp, Artificial Sequence
  Oligonucleotide probe
  misc_binding (1)..(16): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
agavatrrbatytayc

SEQ ID NO: 8513 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
cagavatrtbatyta

SEQ ID NO: 8514 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (15)..(15): base is a locked nucleic acid
agavatrrbatytay

SEQ ID NO: 8515 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (11)..(11): base is a locked nucleic acid
cagavatrtbatyta

SEQ ID NO: 8516 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (14)..(14): base is a locked nucleic acid
agavatrrbatytay

SEQ ID NO: 8517 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (10)..(10): base is a locked nucleic acid
cagavatrtbatyta

SEQ ID NO: 8518 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (11)..(11): base is a locked nucleic acid
agavatrrbatytay

SEQ ID NO: 8519 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (13)..(13): base is a locked nucleic acid
cagavatrtbatyta

SEQ ID NO: 8520 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (4)..(4): base is a locked nucleic acid
  modified_base (8)..(8): base is a locked nucleic acid
  modified_base (9)..(9): base is a locked nucleic acid
agavatrrbatytay

SEQ ID NO: 8521 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (3)..(3): base is a locked nucleic acid
  modified_base (8)..(8): base is a locked nucleic acid
  modified_base (9)..(9): base is a locked nucleic acid
cagavatrtbatyta

SEQ ID NO: 8522 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (2)..(2): base is a locked nucleic acid
  modified_base (8)..(8): base is a locked nucleic acid
  modified_base (9)..(9): base is a locked nucleic acid
agavatrrbatytay

SEQ ID NO: 8523 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (4)..(4): base is a locked nucleic acid
  modified_base (8)..(8): base is a locked nucleic acid
  modified_base (9)..(9): base is a locked nucleic acid
cagavatrtbatyta

SEQ ID NO: 8524 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (5)..(5): base is a locked nucleic acid
  modified_base (8)..(8): base is a locked nucleic acid
  modified_base (9)..(9): base is a locked nucleic acid
agavatrrbatytay

SEQ ID NO: 8525 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (6)..(6): base is a locked nucleic acid
  modified_base (8)..(8): base is a locked nucleic acid
  modified_base (9)..(9): base is a locked nucleic acid
cagavatrtbatyta

SEQ ID NO: 8526 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (3)..(3): base is a locked nucleic acid
  modified_base (8)..(8): base is a locked nucleic acid
  modified_base (9)..(9): base is a locked nucleic acid
agavatrrbatytay

SEQ ID NO: 8527 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (1)..(1): base is a locked nucleic acid
  modified_base (8)..(8): base is a locked nucleic acid
  modified_base (9)..(9): base is a locked nucleic acid
cagavatrtbatyta

SEQ ID NO: 8528 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
agavatrrbatytay

SEQ ID NO: 8529 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
cagavatrtbatyta

SEQ ID NO: 8530 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (11)..(11): base is a locked nucleic acid
agavatrrbatyt

SEQ ID NO: 8531 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (11)..(11): base is a locked nucleic acid
cagavatrtbaty

SEQ ID NO: 8532 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (9)..(9): base is a locked nucleic acid
agavatrrbatyt

SEQ ID NO: 8533 - DNA, 14 bp, Artificial Sequence
  Oligonucleotide probe
  misc_binding (1)..(14): Hybridization probe for the specific detection of mutant HIV-1 at codon 179 of the reverse transcriptase gene.
cagavatrtbatyt

SEQ ID NO: 8534 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (12)..(12): base is a locked nucleic acid
agavatrrbatyt

SEQ ID NO: 8535 - DNA, 14 bp, Artificial Sequence
  Oligonucleotide probe
  misc_binding (1)..(14): Hybridization probe for the specific detection of mutant HIV-1 at codon 179 of the reverse transcriptase gene.
agavatrrbatyta

SEQ ID NO: 8536 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (7)..(7): base is a locked nucleic acid
agavatrrbatyt

SEQ ID NO: 8537 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (5)..(5): base is a locked nucleic acid
cagavatrtbaty

SEQ ID NO: 8538 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
agavatrrbatyt

SEQ ID NO: 8539 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (6)..(6): base is a locked nucleic acid
cagavatrtbaty

SEQ ID NO: 8540 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (5)..(5): base is a locked nucleic acid
agavatrrbatyt

SEQ ID NO: 8541 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (3)..(3): base is a locked nucleic acid
cagavatrtbaty

SEQ ID NO: 8542 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (3)..(3): base is a locked nucleic acid
agavatrrbatyt

SEQ ID NO: 8543 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (7)..(7): base is a locked nucleic acid
cagavatrtbaty

SEQ ID NO: 8544 - DNA, 14 bp, Artificial Sequence
  Oligonucleotide probe
  misc_binding (1)..(14): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
agavatrrbatyta

SEQ ID NO: 8545 - DNA, 14 bp, Artificial Sequence
  Oligonucleotide probe
  misc_binding (1)..(14): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
cagavatrtbatyt

SEQ ID NO: 8546 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (11)..(11): base is a locked nucleic acid
cagavatrtbaty

SEQ ID NO: 8547 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
agavatrrbatyt

SEQ ID NO: 8548 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (10)..(10): base is a locked nucleic acid
cagavatrtbaty

SEQ ID NO: 8549 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (11)..(11): base is a locked nucleic acid
agavatrrbatyt

SEQ ID NO: 8550 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
  modified_base (13)..(13): base is a locked nucleic acid
cagavatrtbaty

SEQ ID NO: 8551 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (4)..(4): base is a locked nucleic acid
  modified_base (8)..(8): base is a locked nucleic acid
  modified_base (9)..(9): base is a locked nucleic acid
agavatrrbatyt

SEQ ID NO: 8552 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (3)..(3): base is a locked nucleic acid
  modified_base (8)..(8): base is a locked nucleic acid
  modified_base (9)..(9): base is a locked nucleic acid
cagavatrtbaty

SEQ ID NO: 8553 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (2)..(2): base is a locked nucleic acid
  modified_base (8)..(8): base is a locked nucleic acid
  modified_base (9)..(9): base is a locked nucleic acid
agavatrrbatyt

SEQ ID NO: 8554 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (4)..(4): base is a locked nucleic acid
  modified_base (8)..(8): base is a locked nucleic acid
  modified_base (9)..(9): base is a locked nucleic acid
cagavatrtbaty

SEQ ID NO: 8555 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (5)..(5): base is a locked nucleic acid
  modified_base (8)..(8): base is a locked nucleic acid
  modified_base (9)..(9): base is a locked nucleic acid
agavatrrbatyt

SEQ ID NO: 8556 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (6)..(6): base is a locked nucleic acid
  modified_base (8)..(8): base is a locked nucleic acid
  modified_base (9)..(9): base is a locked nucleic acid
cagavatrtbaty

SEQ ID NO: 8557 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (3)..(3): base is a locked nucleic acid
  modified_base (8)..(8): base is a locked nucleic acid
  modified_base (9)..(9): base is a locked nucleic acid
agavatrrbatyt

SEQ ID NO: 8558 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (1)..(1): base is a locked nucleic acid
  modified_base (8)..(8): base is a locked nucleic acid
  modified_base (9)..(9): base is a locked nucleic acid
cagavatrtbaty

SEQ ID NO: 8559 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
agavatrrbatyt

SEQ ID NO: 8560 - DNA, 13 bp, Artificial Sequence
  Oligonucleotide probe
  misc_binding (1)..(13): Hybridization probe for the specific detection of mutant HIV-1 at codon 179 of the reverse transcriptase gene.
  modified_base (8)..(8): base is a locked nucleic acid
  modified_base (9)..(9): base is a locked nucleic acid
cagavatrtbaty

SEQ ID NO: 8561 - DNA, 15 bp, Artificial Sequence
  Oligonucleotide probe
  misc_binding (1)..(15): Hybridization probe for the specific detection of mutant HIV-1 at codon 179 of the reverse transcriptase gene.
atagatrtctatgtc

SEQ ID NO: 8562 - DNA, 15 bp, Artificial Sequence
  Oligonucleotide probe
  misc_binding (1)..(15): Hybridization probe for the specific detection of mutant HIV-1 at codon 179 of the reverse transcriptase gene.
atagatytctatgtc

SEQ ID NO: 8563 - DNA, 15 bp, Artificial Sequence
  Oligonucleotide probe
  misc_binding (1)..(15): Hybridization probe for the specific detection of mutant HIV-1 at codon 179 of the reverse transcriptase gene.
atagatraatatgtc

SEQ ID NO: 8564 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  misc_feature (7)..(7): n is a, c, g, or t
atagatngttatgtc

SEQ ID NO: 8565 - DNA, 15 bp, Artificial Sequence
  Oligonucleotide probe
  misc_binding (1)..(15): Hybridization probe for the specific detection of mutant HIV-1 at codon 179 of the reverse transcriptase gene.
  misc_feature (7)..(7): n is a, c, g, or t
atagatnagtatgtc

SEQ ID NO: 8566 - DNA, 18 bp, Artificial Sequence
  Oligonucleotide probe
  misc_binding (1)..(18): Hybridization probe for the specific detection of mutant HIV-1 at codon 179 of the reverse transcriptase gene.
cagavatrrbatytayca

SEQ ID NO: 8567 - DNA, 18 bp, Artificial Sequence
  Oligonucleotide probe
  misc_binding (1)..(18): Hybridization probe for the specific detection of mutant HIV-1 at codon 179 of the reverse transcriptase gene.
ccagavatrtbatytayc

SEQ ID NO: 8568 - DNA, 17 bp, Artificial Sequence
  Oligonucleotide probe
  misc_binding (1)..(17): Hybridization probe for the specific detection of mutant HIV-1 at codon 179 of the reverse transcriptase gene.
agavatrrbatytayca

SEQ ID NO: 8569 - DNA, 17 bp, Artificial Sequence
  Oligonucleotide probe
  misc_binding (1)..(17): Hybridization probe for the specific detection of mutant HIV-1 at codon 179 of the reverse transcriptase gene.
cagavatrtbatytayc

SEQ ID NO: 8570 - DNA, 15 bp, Artificial Sequence
  Oligonucleotide probe
  misc_binding (1)..(15): Hybridization probe for the specific detection of mutant HIV-1 at codon 179 of the reverse transcriptase gene.
agavatrrbatytay

SEQ ID NO: 8571 - DNA, 15 bp, Artificial Sequence
  Oligonucleotide probe
  misc_binding (1)..(15): Hybridization probe for the specific detection of mutant HIV-1 at codon 179 of the reverse transcriptase gene.
cagavatrtbatyta

SEQ ID NO: 8572 - DNA, 16 bp, Artificial Sequence
  Oligonucleotide probe
  misc_binding (1)..(16): Hybridization probe for the specific detection of mutant HIV-1 at codon 179 of the reverse transcriptase gene.
agavatrrbatytayc

SEQ ID NO: 8573 - DNA, 13 bp, Artificial Sequence
  Oligonucleotide probe
  misc_binding (1)..(13): Hybridization probe for the specific detection of mutant HIV-1 at codon 179 of the reverse transcriptase gene.
agavatrrbatyt

SEQ ID NO: 8574 - DNA, 13 bp, Artificial Sequence
  Oligonucleotide probe
  misc_binding (1)..(13): Hybridization probe for the specific detection of mutant HIV-1 at codon 179 of the reverse transcriptase gene.
cagavatrtbaty

SEQ ID NO: 8575 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (11)..(11): base is a locked nucleic acid
trrtbatytycaatayrt

SEQ ID NO: 8576 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (14)..(14): base is a locked nucleic acid
trrtbatytycaatayrt

SEQ ID NO: 8577 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (17)..(17): base is a locked nucleic acid
trrtbatytycaatayrt

SEQ ID NO: 8578 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (15)..(15): base is a locked nucleic acid
trrtbatytycaatayrt

SEQ ID NO: 8579 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (5)..(5): base is a locked nucleic acid
trrtbatytycaatayrt

SEQ ID NO: 8580 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (7)..(7): base is a locked nucleic acid
trrtbatytycaatayrt

SEQ ID NO: 8581 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (2)..(2): base is a locked nucleic acid
trrtbatytycaatayrt

SEQ ID NO: 8582 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (9)..(9): base is a locked nucleic acid
trrtbatytycaatayrt

SEQ ID NO: 8583 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (9)..(9): base is a locked nucleic acid
  modified_base (10)..(10): base is a locked nucleic acid
  modified_base (16)..(16): base is a locked nucleic acid
trrtbatytycaatayrt

SEQ ID NO: 8584 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (9)..(9): base is a locked nucleic acid
  modified_base (10)..(10): base is a locked nucleic acid
  modified_base (17)..(17): base is a locked nucleic acid
trrtbatytycaatayrt

SEQ ID NO: 8585 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (9)..(9): base is a locked nucleic acid
  modified_base (10)..(10): base is a locked nucleic acid
  modified_base (13)..(13): base is a locked nucleic acid
trrtbatytycaatayrt

SEQ ID NO: 8586 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (9)..(9): base is a locked nucleic acid
  modified_base (10)..(10): base is a locked nucleic acid
  modified_base (12)..(12): base is a locked nucleic acid
trrtbatytycaatayrt

SEQ ID NO: 8587 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (5)..(5): base is a locked nucleic acid
  modified_base (9)..(9): base is a locked nucleic acid
  modified_base (10)..(10): base is a locked nucleic acid
trrtbatytycaatayrt

SEQ ID NO: 8588 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (4)..(4): base is a locked nucleic acid
  modified_base (9)..(9): base is a locked nucleic acid
  modified_base (10)..(10): base is a locked nucleic acid
trrtbatytycaatayrt

SEQ ID NO: 8589 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (2)..(2): base is a locked nucleic acid
  modified_base (9)..(9): base is a locked nucleic acid
  modified_base (10)..(10): base is a locked nucleic acid
trrtbatytycaatayrt

SEQ ID NO: 8590 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (10)..(10): base is a locked nucleic acid
trrtbatytycaatayrt

SEQ ID NO: 8591 - DNA, 18 bp, Artificial Sequence
  Oligonucleotide probe
  misc_binding (1)..(18): Hybridization probe for the specific detection of mutant HIV-1 at codon 181 of the reverse transcriptase gene.
  modified_base (9)..(9): base is a locked nucleic acid
  modified_base (10)..(10): base is a locked nucleic acid
trrtbatytycaatayrt

SEQ ID NO: 8592 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (10)..(10): base is a locked nucleic acid
rrtbatytycaatayrt

SEQ ID NO: 8593 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (13)..(13): base is a locked nucleic acid
rrtbatytycaatayrt

SEQ ID NO: 8594 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (16)..(16): base is a locked nucleic acid
rrtbatytycaatayrt

SEQ ID NO: 8595 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (14)..(14): base is a locked nucleic acid
rrtbatytycaatayrt

SEQ ID NO: 8596 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (4)..(4): base is a locked nucleic acid
rrtbatytycaatayrt

SEQ ID NO: 8597 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (6)..(6): base is a locked nucleic acid
rrtbatytycaatayrt

SEQ ID NO: 8598 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (1)..(1): base is a locked nucleic acid
rrtbatytycaatayrt

SEQ ID NO: 8599 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (8)..(8): base is a locked nucleic acid
rrtbatytycaatayrt

SEQ ID NO: 8600 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (15)..(15): base is a locked nucleic acid
rrtbatytycaatayrt

SEQ ID NO: 8601 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (16)..(16): base is a locked nucleic acid
rrtbatytycaatayrt

SEQ ID NO: 8602 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (12)..(12): base is a locked nucleic acid
rrtbatytycaatayrt

SEQ ID NO: 8603 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (11)..(11): base is a locked nucleic acid
rrtbatytycaatayrt

SEQ ID NO: 8604 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (4)..(4): base is a locked nucleic acid
  modified_base (8)..(8): base is a locked nucleic acid
  modified_base (9)..(9): base is a locked nucleic acid
rrtbatytycaatayrt

SEQ ID NO: 8605 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (3)..(3): base is a locked nucleic acid
  modified_base (8)..(8): base is a locked nucleic acid
  modified_base (9)..(9): base is a locked nucleic acid
rrtbatytycaatayrt

SEQ ID NO: 8606 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (1)..(1): base is a locked nucleic acid
  modified_base (8)..(8): base is a locked nucleic acid
  modified_base (9)..(9): base is a locked nucleic acid
rrtbatytycaatayrt

SEQ ID NO: 8607 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (7)..(7): base is a locked nucleic acid
  modified_base (8)..(8): base is a locked nucleic acid
  modified_base (9)..(9): base is a locked nucleic acid
rrtbatytycaatayrt

SEQ ID NO: 8608 - DNA, 17 bp, Artificial Sequence
  Oligonucleotide probe
  misc_binding (1)..(17): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
rrtbatytycaatayrt

SEQ ID NO: 8609 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (10)..(10): base is a locked nucleic acid
rrtbatytycaatay

SEQ ID NO: 8610 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (13)..(13): base is a locked nucleic acid
rrtbatytycaatay

SEQ ID NO: 8611 - DNA, 15 bp, Artificial Sequence
  Oligonucleotide probe
  misc_binding (1)..(15): Hybridization probe for the specific detection of mutant HIV-1 at codon 181 of the reverse transcriptase gene.
rrtbatytycaatay

SEQ ID NO: 8612 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (14)..(14): base is a locked nucleic acid
rrtbatytycaatay

SEQ ID NO: 8613 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (4)..(4): base is a locked nucleic acid
rrtbatytycaatay

SEQ ID NO: 8614 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (6)..(6): base is a locked nucleic acid
rrtbatytycaatay

SEQ ID NO: 8615 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (1)..(1): base is a locked nucleic acid
rrtbatytycaatay

SEQ ID NO: 8616 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (8)..(8): base is a locked nucleic acid
rrtbatytycaatay

SEQ ID NO: 8617 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (15)..(15): base is a locked nucleic acid
rrtbatytycaatay

SEQ ID NO: 8618 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
rrtbatytycaatay

SEQ ID NO: 8619 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (12)..(12): base is a locked nucleic acid
rrtbatytycaatay

SEQ ID NO: 8620 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (11)..(11): base is a locked nucleic acid
rrtbatytycaatay

SEQ ID NO: 8621 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (4)..(4): base is a locked nucleic acid
  modified_base (8)..(8): base is a locked nucleic acid
  modified_base (9)..(9): base is a locked nucleic acid
rrtbatytycaatay

SEQ ID NO: 8622 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (3)..(3): base is a locked nucleic acid
  modified_base (8)..(8): base is a locked nucleic acid
  modified_base (9)..(9): base is a locked nucleic acid
rrtbatytycaatay

SEQ ID NO: 8623 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (1)..(1): base is a locked nucleic acid
  modified_base (8)..(8): base is a locked nucleic acid
  modified_base (9)..(9): base is a locked nucleic acid
rrtbatytycaatay

SEQ ID NO: 8624 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (7)..(7): base is a locked nucleic acid
  modified_base (8)..(8): base is a locked nucleic acid
  modified_base (9)..(9): base is a locked nucleic acid
rrtbatytycaatay

SEQ ID NO: 8625 - DNA, 15 bp, Artificial Sequence
  Oligonucleotide probe
  misc_binding (1)..(15): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
rrtbatytycaatay

SEQ ID NO: 8626 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (10)..(10): base is a locked nucleic acid
rrtbatytycaat

SEQ ID NO: 8627 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (13)..(13): base is a locked nucleic acid
rrtbatytycaat

SEQ ID NO: 8628 - DNA, 14 bp, Artificial Sequence
  Oligonucleotide probe
  misc_binding (1)..(14): Hybridization probe for the specific detection of mutant HIV-1 at codon 181 of the reverse transcriptase gene.
rrtbatytycaata

SEQ ID NO: 8629 - DNA, 13 bp, Artificial Sequence
  Oligonucleotide probe
  misc_binding (1)..(13): Hybridization probe for the specific detection of mutant HIV-1 at codon 181 of the reverse transcriptase gene.
rrtbatytycaat

SEQ ID NO: 8630 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (4)..(4): base is a locked nucleic acid
rrtbatytycaat

SEQ ID NO: 8631 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (6)..(6): base is a locked nucleic acid
rrtbatytycaat

SEQ ID NO: 8632 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (1)..(1): base is a locked nucleic acid
rrtbatytycaat

SEQ ID NO: 8633 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (8)..(8): base is a locked nucleic acid
rrtbatytycaat

SEQ ID NO: 8634 - DNA, 14 bp, Artificial Sequence
  Oligonucleotide probe
  misc_binding (1)..(14): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
rrtbatytycaata

SEQ ID NO: 8635 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (12)..(12): base is a locked nucleic acid
rrtbatytycaat

SEQ ID NO: 8636 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
  modified_base (11)..(11): base is a locked nucleic acid
rrtbatytycaat

SEQ ID NO: 8637 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (4)..(4): base is a locked nucleic acid
  modified_base (8)..(8): base is a locked nucleic acid
  modified_base (9)..(9): base is a locked nucleic acid
rrtbatytycaat

SEQ ID NO: 8638 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (3)..(3): base is a locked nucleic acid
  modified_base (8)..(8): base is a locked nucleic acid
  modified_base (9)..(9): base is a locked nucleic acid
rrtbatytycaat

SEQ ID NO: 8639 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (1)..(1): base is a locked nucleic acid
  modified_base (8)..(8): base is a locked nucleic acid
  modified_base (9)..(9): base is a locked nucleic acid
rrtbatytycaat

SEQ ID NO: 8640 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (7)..(7): base is a locked nucleic acid
  modified_base (8)..(8): base is a locked nucleic acid
  modified_base (9)..(9): base is a locked nucleic acid
rrtbatytycaat

SEQ ID NO: 8641 - DNA, 13 bp, Artificial Sequence
  Oligonucleotide probe
  misc_binding (1)..(13): Hybridization probe for the specific detection of mutant HIV-1 at codon 181 of the reverse transcriptase gene.
  modified_base (8)..(8): base is a locked nucleic acid
  modified_base (9)..(9): base is a locked nucleic acid
rrtbatytycaat

SEQ ID NO: 8642 - DNA, 15 bp, Artificial Sequence
  Oligonucleotide probe
  misc_binding (1)..(15): Hybridization probe for the specific detection of mutant HIV-1 at codon 181 of the reverse transcriptase gene.
ttatctgycaataca

SEQ ID NO: 8643 - DNA, 15 bp, Artificial Sequence
  Oligonucleotide probe
  misc_binding (1)..(15): Hybridization probe for the specific detection of mutant HIV-1 at codon 181 of the reverse transcriptase gene.
ttatcatycaataca

SEQ ID NO: 8644 - DNA, 15 bp, Artificial Sequence
  Oligonucleotide probe
  misc_binding (1)..(15): Hybridization probe for the specific detection of mutant HIV-1 at codon 181 of the reverse transcriptase gene.
ttatcgtycaataca

SEQ ID NO: 8645 - DNA, 18 bp, Artificial Sequence
  Oligonucleotide probe
  misc_binding (1)..(18): Hybridization probe for the specific detection of mutant HIV-1 at codon 181 of the reverse transcriptase gene.
trrtbatytycaatayrt

SEQ ID NO: 8646 - DNA, 17 bp, Artificial Sequence
  Oligonucleotide probe
  misc_binding (1)..(17): Hybridization probe for the specific detection of mutant HIV-1 at codon 181 of the reverse transcriptase gene.
rrtbatytycaatayrt

SEQ ID NO: 8647 - DNA, 15 bp, Artificial Sequence
  Oligonucleotide probe
  misc_binding (1)..(15): Hybridization probe for the specific detection of mutant HIV-1 at codon 181 of the reverse transcriptase gene.
rrtbatytycaatay

SEQ ID NO: 8648 - DNA, 13 bp, Artificial Sequence
  Oligonucleotide probe
  misc_binding (1)..(13): Hybridization probe for the specific detection of mutant HIV-1 at codon 181 of the reverse transcriptase gene.
rrtbatytycaat

SEQ ID NO: 8649 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (12)..(12): base is a locked nucleic acid
taycaataytggatgayt

SEQ ID NO: 8650 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (18)..(18): base is a locked nucleic acid
ycaatayrtgatgayttr

SEQ ID NO: 8651 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (18)..(18): base is a locked nucleic acid
taycaataytggatgayt

SEQ ID NO: 8652 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (11)..(11): base is a locked nucleic acid
ycaatayrtgatgayttr

SEQ ID NO: 8653 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (15)..(15): base is a locked nucleic acid
taycaataytggatgayt

SEQ ID NO: 8654 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (12)..(12): base is a locked nucleic acid
ycaatayrtgatgayttr

SEQ ID NO: 8655 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (16)..(16): base is a locked nucleic acid
taycaataytggatgayt

SEQ ID NO: 8656 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (14)..(14): base is a locked nucleic acid
ycaatayrtgatgayttr

SEQ ID NO: 8657 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
taycaataytggatgayt

SEQ ID NO: 8658 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (5)..(5): base is a locked nucleic acid
ycaatayrtgatgayttr

SEQ ID NO: 8659 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (7)..(7): base is a locked nucleic acid
taycaataytggatgayt

SEQ ID NO: 8660 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (3)..(3): base is a locked nucleic acid
ycaatayrtgatgayttr

SEQ ID NO: 8661 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (4)..(4): base is a locked nucleic acid
taycaataytggatgayt

SEQ ID NO: 8662 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (2)..(2): base is a locked nucleic acid
ycaatayrtgatgayttr

SEQ ID NO: 8663 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (6)..(6): base is a locked nucleic acid
taycaataytggatgayt

SEQ ID NO: 8664 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (8)..(8): base is a locked nucleic acid
ycaatayrtgatgayttr

SEQ ID NO: 8665 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (13)..(13): base is a locked nucleic acid
taycaataytggatgayt

SEQ ID NO: 8666 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (12)..(12): base is a locked nucleic acid
ycaatayrtgatgayttr

SEQ ID NO: 8667 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (15)..(15): base is a locked nucleic acid
taycaataytggatgayt

SEQ ID NO: 8668 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (13)..(13): base is a locked nucleic acid
ycaatayrtgatgayttr

SEQ ID NO: 8669 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (18)..(18): base is a locked nucleic acid
taycaataytggatgayt

SEQ ID NO: 8670 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (18)..(18): base is a locked nucleic acid
ycaatayrtgatgayttr

SEQ ID NO: 8671 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (14)..(14): base is a locked nucleic acid
taycaataytggatgayt

SEQ ID NO: 8672 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
  modified_base (14)..(14): base is a locked nucleic acid
ycaatayrtgatgayttr

SEQ ID NO: 8673 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (2)..(2): base is a locked nucleic acid
  modified_base (9)..(9): base is a locked nucleic acid
  modified_base (10)..(10): base is a locked nucleic acid
taycaataytggatgayt

SEQ ID NO: 8674 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (7)..(7): base is a locked nucleic acid
  modified_base (9)..(9): base is a locked nucleic acid
  modified_base (10)..(10): base is a locked nucleic acid
ycaatayrtgatgayttr

SEQ ID NO: 8675 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (10)..(10): base is a locked nucleic acid
taycaataytggatgayt

SEQ ID NO: 8676 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (2)..(2): base is a locked nucleic acid
  modified_base (9)..(9): base is a locked nucleic acid
  modified_base (10)..(10): base is a locked nucleic acid
ycaatayrtgatgayttr

SEQ ID NO: 8677 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (4)..(4): base is a locked nucleic acid
  modified_base (9)..(9): base is a locked nucleic acid
  modified_base (10)..(10): base is a locked nucleic acid
taycaataytggatgayt

SEQ ID NO: 8678 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (5)..(5): base is a locked nucleic acid
  modified_base (9)..(9): base is a locked nucleic acid
  modified_base (10)..(10): base is a locked nucleic acid
ycaatayrtgatgayttr

SEQ ID NO: 8679 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (5)..(5): base is a locked nucleic acid
  modified_base (9)..(9): base is a locked nucleic acid
  modified_base (10)..(10): base is a locked nucleic acid
taycaataytggatgayt

SEQ ID NO: 8680 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (10)..(10): base is a locked nucleic acid
ycaatayrtgatgayttr

SEQ ID NO: 8681 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
taycaataytggatgayt

SEQ ID NO: 8682 - DNA, 18 bp, Artificial Sequence
  Oligonucleotide probe
  misc_binding (1)..(18): Hybridization probe for the specific detection of mutant HIV-1 at codon 184 of the reverse transcriptase gene.
  modified_base (9)..(9): base is a locked nucleic acid
  modified_base (10)..(10): base is a locked nucleic acid
ycaatayrtgatgayttr

SEQ ID NO: 8683 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (11)..(11): base is a locked nucleic acid
aycaataytggatgayt

SEQ ID NO: 8684 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (17)..(17): base is a locked nucleic acid
caatayrtgatgayttr

SEQ ID NO: 8685 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (17)..(17): base is a locked nucleic acid
aycaataytggatgayt

SEQ ID NO: 8686 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (10)..(10): base is a locked nucleic acid
caatayrtgatgayttr

SEQ ID NO: 8687 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (14)..(14): base is a locked nucleic acid
aycaataytggatgayt

SEQ ID NO: 8688 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (11)..(11): base is a locked nucleic acid
caatayrtgatgayttr

SEQ ID NO: 8689 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (15)..(15): base is a locked nucleic acid
aycaataytggatgayt

SEQ ID NO: 8690 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (13)..(13): base is a locked nucleic acid
caatayrtgatgayttr

SEQ ID NO: 8691 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
aycaataytggatgayt

SEQ ID NO: 8692 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (4)..(4): base is a locked nucleic acid
caatayrtgatgayttr

SEQ ID NO: 8693 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (6)..(6): base is a locked nucleic acid
aycaataytggatgayt

SEQ ID NO: 8694 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (2)..(2): base is a locked nucleic acid
caatayrtgatgayttr

SEQ ID NO: 8695 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (3)..(3): base is a locked nucleic acid
aycaataytggatgayt

SEQ ID NO: 8696 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (1)..(1): base is a locked nucleic acid
caatayrtgatgayttr

SEQ ID NO: 8697 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (5)..(5): base is a locked nucleic acid
aycaataytggatgayt

SEQ ID NO: 8698 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (7)..(7): base is a locked nucleic acid
caatayrtgatgayttr

SEQ ID NO: 8699 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (12)..(12): base is a locked nucleic acid
aycaataytggatgayt

SEQ ID NO: 8700 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (11)..(11): base is a locked nucleic acid
caatayrtgatgayttr

SEQ ID NO: 8701 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (14)..(14): base is a locked nucleic acid
aycaataytggatgayt

SEQ ID NO: 8702 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (12)..(12): base is a locked nucleic acid
caatayrtgatgayttr

SEQ ID NO: 8703 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (17)..(17): base is a locked nucleic acid
aycaataytggatgayt

SEQ ID NO: 8704 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (17)..(17): base is a locked nucleic acid
caatayrtgatgayttr

SEQ ID NO: 8705 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (13)..(13): base is a locked nucleic acid
aycaataytggatgayt

SEQ ID NO: 8706 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (13)..(13): base is a locked nucleic acid
caatayrtgatgayttr

SEQ ID NO: 8707 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (1)..(1): base is a locked nucleic acid
  modified_base (8)..(8): base is a locked nucleic acid
  modified_base (9)..(9): base is a locked nucleic acid
aycaataytggatgayt

SEQ ID NO: 8708 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (6)..(6): base is a locked nucleic acid
  modified_base (8)..(8): base is a locked nucleic acid
  modified_base (9)..(9): base is a locked nucleic acid
caatayrtgatgayttr

SEQ ID NO: 8709 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (7)..(7): base is a locked nucleic acid
  modified_base (8)..(8): base is a locked nucleic acid
  modified_base (9)..(9): base is a locked nucleic acid
aycaataytggatgayt

SEQ ID NO: 8710 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (1)..(1): base is a locked nucleic acid
  modified_base (8)..(8): base is a locked nucleic acid
  modified_base (9)..(9): base is a locked nucleic acid
caatayrtgatgayttr

SEQ ID NO: 8711 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (3)..(3): base is a locked nucleic acid
  modified_base (8)..(8): base is a locked nucleic acid
  modified_base (9)..(9): base is a locked nucleic acid
aycaataytggatgayt

SEQ ID NO: 8712 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (4)..(4): base is a locked nucleic acid
  modified_base (8)..(8): base is a locked nucleic acid
  modified_base (9)..(9): base is a locked nucleic acid
caatayrtgatgayttr

SEQ ID NO: 8713 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (4)..(4): base is a locked nucleic acid
  modified_base (8)..(8): base is a locked nucleic acid
  modified_base (9)..(9): base is a locked nucleic acid
aycaataytggatgayt

SEQ ID NO: 8714 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (7)..(7): base is a locked nucleic acid
  modified_base (8)..(8): base is a locked nucleic acid
  modified_base (9)..(9): base is a locked nucleic acid
caatayrtgatgayttr

SEQ ID NO: 8715 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
aycaataytggatgayt

SEQ ID NO: 8716 - DNA, 17 bp, Artificial Sequence
  Oligonucleotide probe
  misc_binding (1)..(17): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
caatayrtgatgayttr

SEQ ID NO: 8717 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (11)..(11): base is a locked nucleic acid
aycaataytggatga

SEQ ID NO: 8718 - DNA, 16 bp, Artificial Sequence
  Oligonucleotide probe
  misc_binding (1)..(16): Hybridization probe for the specific detection of mutant HIV-1 at codon 184 of the reverse transcriptase gene.
caatayrtgatgaytt

SEQ ID NO: 8719 - DNA, 16 bp, Artificial Sequence
  Oligonucleotide probe
  misc_binding (1)..(16): Hybridization probe for the specific detection of mutant HIV-1 at codon 184 of the reverse transcriptase gene.
aycaataytggatgay

SEQ ID NO: 8720 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (10)..(10): base is a locked nucleic acid
caatayrtgatgayt

SEQ ID NO: 8721 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (14)..(14): base is a locked nucleic acid
aycaataytggatga

SEQ ID NO: 8722 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (11)..(11): base is a locked nucleic acid
caatayrtgatgayt

SEQ ID NO: 8723 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (15)..(15): base is a locked nucleic acid
aycaataytggatga

SEQ ID NO: 8724 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (13)..(13): base is a locked nucleic acid
caatayrtgatgayt

SEQ ID NO: 8725 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
aycaataytggatga

SEQ ID NO: 8726 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (4)..(4): base is a locked nucleic acid
caatayrtgatgayt

SEQ ID NO: 8727 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (6)..(6): base is a locked nucleic acid
aycaataytggatga

SEQ ID NO: 8728 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (2)..(2): base is a locked nucleic acid
caatayrtgatgayt

SEQ ID NO: 8729 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (3)..(3): base is a locked nucleic acid
aycaataytggatga

SEQ ID NO: 8730 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (1)..(1): base is a locked nucleic acid
caatayrtgatgayt

SEQ ID NO: 8731 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (5)..(5): base is a locked nucleic acid
aycaataytggatga

SEQ ID NO: 8732 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (7)..(7): base is a locked nucleic acid
caatayrtgatgayt

SEQ ID NO: 8733 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (12)..(12): base is a locked nucleic acid
aycaataytggatga

SEQ ID NO: 8734 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (11)..(11): base is a locked nucleic acid
caatayrtgatgayt

SEQ ID NO: 8735 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (14)..(14): base is a locked nucleic acid
aycaataytggatga

SEQ ID NO: 8736 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (12)..(12): base is a locked nucleic acid
caatayrtgatgayt

SEQ ID NO: 8737 - DNA, 16 bp, Artificial Sequence
  Oligonucleotide probe
  misc_binding (1)..(16): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
aycaataytggatgay

SEQ ID NO: 8738 - DNA, 16 bp, Artificial Sequence
  Oligonucleotide probe
  misc_binding (1)..(16): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
caatayrtgatgaytt

SEQ ID NO: 8739 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (13)..(13): base is a locked nucleic acid
aycaataytggatga

SEQ ID NO: 8740 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (13)..(13): base is a locked nucleic acid
caatayrtgatgayt

SEQ ID NO: 8741 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (1)..(1): base is a locked nucleic acid
  modified_base (8)..(8): base is a locked nucleic acid
  modified_base (9)..(9): base is a locked nucleic acid
aycaataytggatga

SEQ ID NO: 8742 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (6)..(6): base is a locked nucleic acid
  modified_base (8)..(8): base is a locked nucleic acid
  modified_base (9)..(9): base is a locked nucleic acid
caatayrtgatgayt

SEQ ID NO: 8743 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (7)..(7): base is a locked nucleic acid
  modified_base (8)..(8): base is a locked nucleic acid
  modified_base (9)..(9): base is a locked nucleic acid
aycaataytggatga

SEQ ID NO: 8744 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (1)..(1): base is a locked nucleic acid
  modified_base (8)..(8): base is a locked nucleic acid
  modified_base (9)..(9): base is a locked nucleic acid
caatayrtgatgayt

SEQ ID NO: 8745 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (3)..(3): base is a locked nucleic acid
  modified_base (8)..(8): base is a locked nucleic acid
  modified_base (9)..(9): base is a locked nucleic acid
aycaataytggatga

SEQ ID NO: 8746 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (4)..(4): base is a locked nucleic acid
  modified_base (8)..(8): base is a locked nucleic acid
  modified_base (9)..(9): base is a locked nucleic acid
caatayrtgatgayt

SEQ ID NO: 8747 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (4)..(4): base is a locked nucleic acid
  modified_base (8)..(8): base is a locked nucleic acid
  modified_base (9)..(9): base is a locked nucleic acid
aycaataytggatga

SEQ ID NO: 8748 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (7)..(7): base is a locked nucleic acid
  modified_base (8)..(8): base is a locked nucleic acid
  modified_base (9)..(9): base is a locked nucleic acid
caatayrtgatgayt

SEQ ID NO: 8749 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
aycaataytggatga

SEQ ID NO: 8750 - DNA, 15 bp, Artificial Sequence
  Oligonucleotide probe
  misc_binding (1)..(15): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
caatayrtgatgayt

SEQ ID NO: 8751 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (11)..(11): base is a locked nucleic acid
aycaataytggat

SEQ ID NO: 8752 - DNA, 14 bp, Artificial Sequence
  Oligonucleotide probe
  misc_binding (1)..(14): Hybridization probe for the specific detection of mutant HIV-1 at codon 184 of the reverse transcriptase gene.
caatayrtgatgay

SEQ ID NO: 8753 - DNA, 14 bp, Artificial Sequence
  Oligonucleotide probe
  misc_binding (1)..(14): Hybridization probe for the specific detection of mutant HIV-1 at codon 184 of the reverse transcriptase gene.
aycaataytggatg

SEQ ID NO: 8754 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (10)..(10): base is a locked nucleic acid
caatayrtgatga

SEQ ID NO: 8755 - DNA, 13 bp, Artificial Sequence
  Oligonucleotide probe
  misc_binding (1)..(13): Hybridization probe for the specific detection of mutant HIV-1 at codon 184 of the reverse transcriptase gene.
aycaataytggat

SEQ ID NO: 8756 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (11)..(11): base is a locked nucleic acid
caatayrtgatga

SEQ ID NO: 8757 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (13)..(13): base is a locked nucleic acid
caatayrtgatga

SEQ ID NO: 8758 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
aycaataytggat

SEQ ID NO: 8759 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (4)..(4): base is a locked nucleic acid
caatayrtgatga

SEQ ID NO: 8760 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (6)..(6): base is a locked nucleic acid
aycaataytggat

SEQ ID NO: 8761 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (2)..(2): base is a locked nucleic acid
caatayrtgatga

SEQ ID NO: 8762 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (3)..(3): base is a locked nucleic acid
aycaataytggat

SEQ ID NO: 8763 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (1)..(1): base is a locked nucleic acid
caatayrtgatga

SEQ ID NO: 8764 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (5)..(5): base is a locked nucleic acid
aycaataytggat

SEQ ID NO: 8765 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (7)..(7): base is a locked nucleic acid
caatayrtgatga

SEQ ID NO: 8766 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (12)..(12): base is a locked nucleic acid
aycaataytggat

SEQ ID NO: 8767 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (11)..(11): base is a locked nucleic acid
caatayrtgatga

SEQ ID NO: 8768 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
aycaataytggat

SEQ ID NO: 8769 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (12)..(12): base is a locked nucleic acid
caatayrtgatga

SEQ ID NO: 8770 - DNA, 14 bp, Artificial Sequence
  Oligonucleotide probe
  misc_binding (1)..(14): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
aycaataytggatg

SEQ ID NO: 8771 - DNA, 14 bp, Artificial Sequence
  Oligonucleotide probe
  misc_binding (1)..(14): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
caatayrtgatgay

SEQ ID NO: 8772 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (13)..(13): base is a locked nucleic acid
aycaataytggat

SEQ ID NO: 8773 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
  modified_base (13)..(13): base is a locked nucleic acid
caatayrtgatga

SEQ ID NO: 8774 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (1)..(1): base is a locked nucleic acid
  modified_base (8)..(8): base is a locked nucleic acid
  modified_base (9)..(9): base is a locked nucleic acid
aycaataytggat

SEQ ID NO: 8775 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (6)..(6): base is a locked nucleic acid
  modified_base (8)..(8): base is a locked nucleic acid
  modified_base (9)..(9): base is a locked nucleic acid
caatayrtgatga

SEQ ID NO: 8776 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (7)..(7): base is a locked nucleic acid
  modified_base (8)..(8): base is a locked nucleic acid
  modified_base (9)..(9): base is a locked nucleic acid
aycaataytggat

SEQ ID NO: 8777 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (1)..(1): base is a locked nucleic acid
  modified_base (8)..(8): base is a locked nucleic acid
  modified_base (9)..(9): base is a locked nucleic acid
caatayrtgatga

SEQ ID NO: 8778 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (3)..(3): base is a locked nucleic acid
  modified_base (8)..(8): base is a locked nucleic acid
  modified_base (9)..(9): base is a locked nucleic acid
aycaataytggat

SEQ ID NO: 8779 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (4)..(4): base is a locked nucleic acid
  modified_base (8)..(8): base is a locked nucleic acid
  modified_base (9)..(9): base is a locked nucleic acid
caatayrtgatga

SEQ ID NO: 8780 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (4)..(4): base is a locked nucleic acid
  modified_base (8)..(8): base is a locked nucleic acid
  modified_base (9)..(9): base is a locked nucleic acid
aycaataytggat

SEQ ID NO: 8781 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (7)..(7): base is a locked nucleic acid
  modified_base (8)..(8): base is a locked nucleic acid
  modified_base (9)..(9): base is a locked nucleic acid
caatayrtgatga

SEQ ID NO: 8782 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
aycaataytggat

SEQ ID NO: 8783 - DNA, 13 bp, Artificial Sequence
  Oligonucleotide probe
  misc_binding (1)..(13): Hybridization probe for the specific detection of mutant HIV-1 at codon 184 of the reverse transcriptase gene.
  modified_base (8)..(8): base is a locked nucleic acid
  modified_base (9)..(9): base is a locked nucleic acid
caatayrtgatga

SEQ ID NO: 8784 - DNA, 15 bp, Artificial Sequence
  Oligonucleotide probe
  misc_binding (1)..(15): Hybridization probe for the specific detection of mutant HIV-1 at codon 184 of the reverse transcriptase gene.
tcaatacgtggatga

SEQ ID NO: 8785 - DNA, 15 bp, Artificial Sequence
  Oligonucleotide probe
  misc_binding (1)..(15): Hybridization probe for the specific detection of mutant HIV-1 at codon 184 of the reverse transcriptase gene.
tcaatacathgatga

SEQ ID NO: 8786 - DNA, 18 bp, Artificial Sequence
  Oligonucleotide probe
  misc_binding (1)..(18): Hybridization probe for the specific detection of mutant HIV-1 at codon 184 of the reverse transcriptase gene.
taycaataytggatgayt

SEQ ID NO: 8787 - DNA, 18 bp, Artificial Sequence
  Oligonucleotide probe
  misc_binding (1)..(18): Hybridization probe for the specific detection of mutant HIV-1 at codon 184 of the reverse transcriptase gene.
ycaatayrtgatgayttr

SEQ ID NO: 8788 - DNA, 17 bp, Artificial Sequence
  Oligonucleotide probe
  misc_binding (1)..(17): Hybridization probe for the specific detection of mutant HIV-1 at codon 184 of the reverse transcriptase gene.
aycaataytggatgayt

SEQ ID NO: 8789 - DNA, 17 bp, Artificial Sequence
  Oligonucleotide probe
  misc_binding (1)..(17): Hybridization probe for the specific detection of mutant HIV-1 at codon 184 of the reverse transcriptase gene.
caatayrtgatgayttr

SEQ ID NO: 8790 - DNA, 15 bp, Artificial Sequence
  Oligonucleotide probe
  misc_binding (1)..(15): Hybridization probe for the specific detection of mutant HIV-1 at codon 184 of the reverse transcriptase gene.
aycaataytggatga

SEQ ID NO: 8791 - DNA, 15 bp, Artificial Sequence
  Oligonucleotide probe
  misc_binding (1)..(15): Hybridization probe for the specific detection of mutant HIV-1 at codon 184 of the reverse transcriptase gene.
caatayrtgatgayt

SEQ ID NO: 8792 - DNA, 13 bp, Artificial Sequence
  Oligonucleotide probe
  misc_binding (1)..(13): Hybridization probe for the specific detection of mutant HIV-1 at codon 184 of the reverse transcriptase gene.
aycaataytggat

SEQ ID NO: 8793 - DNA, 13 bp, Artificial Sequence
  Oligonucleotide probe
  misc_binding (1)..(13): Hybridization probe for the specific detection of mutant HIV-1 at codon 184 of the reverse transcriptase gene.
caatayrtgatga

SEQ ID NO: 8794 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (15)..(15): base is a locked nucleic acid
atgayttrttgtaggmtc

SEQ ID NO: 8795 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (11)..(11): base is a locked nucleic acid
gatgayttratgtaggmt

SEQ ID NO: 8796 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (14)..(14): base is a locked nucleic acid
atgayttrttgtaggmtc

SEQ ID NO: 8797 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (13)..(13): base is a locked nucleic acid
gatgayttratgtaggmt

SEQ ID NO: 8798 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (10)..(10): base is a locked nucleic acid
atgayttrttgtaggmtc

SEQ ID NO: 8799 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (16)..(16): base is a locked nucleic acid
gatgayttratgtaggmt

SEQ ID NO: 8800 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (18)..(18): base is a locked nucleic acid
atgayttrttgtaggmtc

SEQ ID NO: 8801 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (15)..(15): base is a locked nucleic acid
gatgayttratgtaggmt

SEQ ID NO: 8802 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (2)..(2): base is a locked nucleic acid
atgayttrttgtaggmtc

SEQ ID NO: 8803 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (3)..(3): base is a locked nucleic acid
gatgayttratgtaggmt

SEQ ID NO: 8804 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (3)..(3): base is a locked nucleic acid
atgayttrttgtaggmtc

SEQ ID NO: 8805 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (2)..(2): base is a locked nucleic acid
gatgayttratgtaggmt

SEQ ID NO: 8806 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (6)..(6): base is a locked nucleic acid
atgayttrttgtaggmtc

SEQ ID NO: 8807 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (4)..(4): base is a locked nucleic acid
gatgayttratgtaggmt

SEQ ID NO: 8808 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (4)..(4): base is a locked nucleic acid
atgayttrttgtaggmtc

SEQ ID NO: 8809 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (6)..(6): base is a locked nucleic acid
gatgayttratgtaggmt

SEQ ID NO: 8810 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (12)..(12): base is a locked nucleic acid
atgayttrttgtaggmtc

SEQ ID NO: 8811 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (15)..(15): base is a locked nucleic acid
gatgayttratgtaggmt

SEQ ID NO: 8812 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (17)..(17): base is a locked nucleic acid
atgayttrttgtaggmtc

SEQ ID NO: 8813 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (18)..(18): base is a locked nucleic acid
gatgayttratgtaggmt

SEQ ID NO: 8814 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (16)..(16): base is a locked nucleic acid
atgayttrttgtaggmtc

SEQ ID NO: 8815 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (14)..(14): base is a locked nucleic acid
gatgayttratgtaggmt

SEQ ID NO: 8816 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (14)..(14): base is a locked nucleic acid
atgayttrttgtaggmtc

SEQ ID NO: 8817 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
  modified_base (12)..(12): base is a locked nucleic acid
gatgayttratgtaggmt

SEQ ID NO: 8818 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (10)..(10): base is a locked nucleic acid
atgayttrttgtaggmtc

SEQ ID NO: 8819 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (5)..(5): base is a locked nucleic acid
  modified_base (9)..(9): base is a locked nucleic acid
  modified_base (10)..(10): base is a locked nucleic acid
gatgayttratgtaggmt

SEQ ID NO: 8820 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (6)..(6): base is a locked nucleic acid
  modified_base (9)..(9): base is a locked nucleic acid
  modified_base (10)..(10): base is a locked nucleic acid
atgayttrttgtaggmtc

SEQ ID NO: 8821 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (3)..(3): base is a locked nucleic acid
  modified_base (9)..(9): base is a locked nucleic acid
  modified_base (10)..(10): base is a locked nucleic acid
gatgayttratgtaggmt

SEQ ID NO: 8822 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (7)..(7): base is a locked nucleic acid
  modified_base (9)..(9): base is a locked nucleic acid
  modified_base (10)..(10): base is a locked nucleic acid
atgayttrttgtaggmtc

SEQ ID NO: 8823 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (4)..(4): base is a locked nucleic acid
  modified_base (9)..(9): base is a locked nucleic acid
  modified_base (10)..(10): base is a locked nucleic acid
gatgayttratgtaggmt

SEQ ID NO: 8824 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (3)..(3): base is a locked nucleic acid
  modified_base (9)..(9): base is a locked nucleic acid
  modified_base (10)..(10): base is a locked nucleic acid
atgayttrttgtaggmtc

SEQ ID NO: 8825 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (10)..(10): base is a locked nucleic acid
gatgayttratgtaggmt

SEQ ID NO: 8826 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
atgayttrttgtaggmtc

SEQ ID NO: 8827 - DNA, 18 bp, Artificial Sequence
  Oligonucleotide probe
  misc_binding (1)..(18): Hybridization probe for the specific detection of mutant HIV-1 at codon 188 of the reverse transcriptase gene.
  modified_base (9)..(9): base is a locked nucleic acid
  modified_base (10)..(10): base is a locked nucleic acid
gatgayttratgtaggmt

SEQ ID NO: 8828 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (14)..(14): base is a locked nucleic acid
tgayttrttgtaggmtc

SEQ ID NO: 8829 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (10)..(10): base is a locked nucleic acid
atgayttratgtaggmt

SEQ ID NO: 8830 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (13)..(13): base is a locked nucleic acid
tgayttrttgtaggmtc

SEQ ID NO: 8831 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (12)..(12): base is a locked nucleic acid
atgayttratgtaggmt

SEQ ID NO: 8832 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (9)..(9): base is a locked nucleic acid
tgayttrttgtaggmtc

SEQ ID NO: 8833 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (15)..(15): base is a locked nucleic acid
atgayttratgtaggmt

SEQ ID NO: 8834 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (17)..(17): base is a locked nucleic acid
tgayttrttgtaggmtc

SEQ ID NO: 8835 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (14)..(14): base is a locked nucleic acid
atgayttratgtaggmt

SEQ ID NO: 8836 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (1)..(1): base is a locked nucleic acid
tgayttrttgtaggmtc

SEQ ID NO: 8837 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (2)..(2): base is a locked nucleic acid
atgayttratgtaggmt

SEQ ID NO: 8838 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (2)..(2): base is a locked nucleic acid
tgayttrttgtaggmtc

SEQ ID NO: 8839 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (1)..(1): base is a locked nucleic acid
atgayttratgtaggmt

SEQ ID NO: 8840 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (5)..(5): base is a locked nucleic acid
tgayttrttgtaggmtc

SEQ ID NO: 8841 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (3)..(3): base is a locked nucleic acid
atgayttratgtaggmt

SEQ ID NO: 8842 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (3)..(3): base is a locked nucleic acid
tgayttrttgtaggmtc

SEQ ID NO: 8843 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (5)..(5): base is a locked nucleic acid
atgayttratgtaggmt

SEQ ID NO: 8844 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
tgayttrttgtaggmtc

SEQ ID NO: 8845 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (14)..(14): base is a locked nucleic acid
atgayttratgtaggmt

SEQ ID NO: 8846 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (16)..(16): base is a locked nucleic acid
tgayttrttgtaggmtc

SEQ ID NO: 8847 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (17)..(17): base is a locked nucleic acid
atgayttratgtaggmt

SEQ ID NO: 8848 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (15)..(15): base is a locked nucleic acid
tgayttrttgtaggmtc

SEQ ID NO: 8849 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (13)..(13): base is a locked nucleic acid
atgayttratgtaggmt

SEQ ID NO: 8850 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (13)..(13): base is a locked nucleic acid
tgayttrttgtaggmtc

SEQ ID NO: 8851 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
atgayttratgtaggmt

SEQ ID NO: 8852 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (7)..(7): base is a locked nucleic acid
  modified_base (8)..(8): base is a locked nucleic acid
  modified_base (9)..(9): base is a locked nucleic acid
tgayttrttgtaggmtc

SEQ ID NO: 8853 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (4)..(4): base is a locked nucleic acid
  modified_base (8)..(8): base is a locked nucleic acid
  modified_base (9)..(9): base is a locked nucleic acid
atgayttratgtaggmt

SEQ ID NO: 8854 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (5)..(5): base is a locked nucleic acid
  modified_base (8)..(8): base is a locked nucleic acid
  modified_base (9)..(9): base is a locked nucleic acid
tgayttrttgtaggmtc

SEQ ID NO: 8855 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (2)..(2): base is a locked nucleic acid
  modified_base (8)..(8): base is a locked nucleic acid
  modified_base (9)..(9): base is a locked nucleic acid
atgayttratgtaggmt

SEQ ID NO: 8856 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (6)..(6): base is a locked nucleic acid
  modified_base (8)..(8): base is a locked nucleic acid
  modified_base (9)..(9): base is a locked nucleic acid
tgayttrttgtaggmtc

SEQ ID NO: 8857 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (3)..(3): base is a locked nucleic acid
  modified_base (8)..(8): base is a locked nucleic acid
  modified_base (9)..(9): base is a locked nucleic acid
atgayttratgtaggmt

SEQ ID NO: 8858 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (2)..(2): base is a locked nucleic acid
  modified_base (8)..(8): base is a locked nucleic acid
  modified_base (9)..(9): base is a locked nucleic acid
tgayttrttgtaggmtc

SEQ ID NO: 8859 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (7)..(7): base is a locked nucleic acid
  modified_base (8)..(8): base is a locked nucleic acid
  modified_base (9)..(9): base is a locked nucleic acid
atgayttratgtaggmt

SEQ ID NO: 8860 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
tgayttrttgtaggmtc

SEQ ID NO: 8861 - DNA, 17 bp, Artificial Sequence
  Oligonucleotide probe
  misc_binding (1)..(17): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
atgayttratgtaggmt

SEQ ID NO: 8862 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (14)..(14): base is a locked nucleic acid
tgayttrttgtaggm

SEQ ID NO: 8863 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (10)..(10): base is a locked nucleic acid
atgayttratgtagg

SEQ ID NO: 8864 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (13)..(13): base is a locked nucleic acid
tgayttrttgtaggm

SEQ ID NO: 8865 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (12)..(12): base is a locked nucleic acid
atgayttratgtagg

SEQ ID NO: 8866 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (9)..(9): base is a locked nucleic acid
tgayttrttgtaggm

SEQ ID NO: 8867 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (15)..(15): base is a locked nucleic acid
atgayttratgtagg

SEQ ID NO: 8868 - DNA, 16 bp, Artificial Sequence
  Oligonucleotide probe
  misc_binding (1)..(16): Hybridization probe for the specific detection of mutant HIV-1 at codon 188 of the reverse transcriptase gene.
tgayttrttgtaggmt

SEQ ID NO: 8869 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (14)..(14): base is a locked nucleic acid
atgayttratgtagg

SEQ ID NO: 8870 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (1)..(1): base is a locked nucleic acid
tgayttrttgtaggm

SEQ ID NO: 8871 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (2)..(2): base is a locked nucleic acid
atgayttratgtagg

SEQ ID NO: 8872 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (2)..(2): base is a locked nucleic acid
tgayttrttgtaggm

SEQ ID NO: 8873 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (1)..(1): base is a locked nucleic acid
atgayttratgtagg

SEQ ID NO: 8874 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (5)..(5): base is a locked nucleic acid
tgayttrttgtaggm

SEQ ID NO: 8875 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (3)..(3): base is a locked nucleic acid
atgayttratgtagg

SEQ ID NO: 8876 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (3)..(3): base is a locked nucleic acid
tgayttrttgtaggm

SEQ ID NO: 8877 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (5)..(5): base is a locked nucleic acid
atgayttratgtagg

SEQ ID NO: 8878 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
tgayttrttgtaggm

SEQ ID NO: 8879 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (14)..(14): base is a locked nucleic acid
atgayttratgtagg

SEQ ID NO: 8880 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
tgayttrttgtaggm

SEQ ID NO: 8881 - DNA, 16 bp, Artificial Sequence
  Oligonucleotide probe
  misc_binding (1)..(16): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
atgayttratgtaggm

SEQ ID NO: 8882 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (15)..(15): base is a locked nucleic acid
tgayttrttgtaggm

SEQ ID NO: 8883 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (13)..(13): base is a locked nucleic acid
atgayttratgtagg

SEQ ID NO: 8884 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (13)..(13): base is a locked nucleic acid
tgayttrttgtaggm

SEQ ID NO: 8885 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
atgayttratgtagg

SEQ ID NO: 8886 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (7)..(7): base is a locked nucleic acid
  modified_base (8)..(8): base is a locked nucleic acid
  modified_base (9)..(9): base is a locked nucleic acid
tgayttrttgtaggm

SEQ ID NO: 8887 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (4)..(4): base is a locked nucleic acid
  modified_base (8)..(8): base is a locked nucleic acid
  modified_base (9)..(9): base is a locked nucleic acid
atgayttratgtagg

SEQ ID NO: 8888 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (5)..(5): base is a locked nucleic acid
  modified_base (8)..(8): base is a locked nucleic acid
  modified_base (9)..(9): base is a locked nucleic acid
tgayttrttgtaggm

SEQ ID NO: 8889 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (2)..(2): base is a locked nucleic acid
  modified_base (8)..(8): base is a locked nucleic acid
  modified_base (9)..(9): base is a locked nucleic acid
atgayttratgtagg

SEQ ID NO: 8890 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (6)..(6): base is a locked nucleic acid
  modified_base (8)..(8): base is a locked nucleic acid
  modified_base (9)..(9): base is a locked nucleic acid
tgayttrttgtaggm

SEQ ID NO: 8891 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (3)..(3): base is a locked nucleic acid
  modified_base (8)..(8): base is a locked nucleic acid
  modified_base (9)..(9): base is a locked nucleic acid
atgayttratgtagg

SEQ ID NO: 8892 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (2)..(2): base is a locked nucleic acid
  modified_base (8)..(8): base is a locked nucleic acid
  modified_base (9)..(9): base is a locked nucleic acid
tgayttrttgtaggm

SEQ ID NO: 8893 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (7)..(7): base is a locked nucleic acid
  modified_base (8)..(8): base is a locked nucleic acid
  modified_base (9)..(9): base is a locked nucleic acid
atgayttratgtagg

SEQ ID NO: 8894 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
tgayttrttgtaggm

SEQ ID NO: 8895 - DNA, 15 bp, Artificial Sequence
  Oligonucleotide probe
  misc_binding (1)..(15): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
atgayttratgtagg

SEQ ID NO: 8896 - DNA, 13 bp, Artificial Sequence
  Oligonucleotide probe
  misc_binding (1)..(13): Hybridization probe for the specific detection of mutant HIV-1 at codon 188 of the reverse transcriptase gene.
tgayttrttgtag

SEQ ID NO: 8897 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (10)..(10): base is a locked nucleic acid
atgayttratgta

SEQ ID NO: 8898 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (13)..(13): base is a locked nucleic acid
tgayttrttgtag

SEQ ID NO: 8899 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (12)..(12): base is a locked nucleic acid
atgayttratgta

SEQ ID NO: 8900 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (9)..(9): base is a locked nucleic acid
tgayttrttgtag

SEQ ID NO: 8901 - DNA, 14 bp, Artificial Sequence
  Oligonucleotide probe
  misc_binding (1)..(14): Hybridization probe for the specific detection of mutant HIV-1 at codon 188 of the reverse transcriptase gene.
atgayttratgtag

SEQ ID NO: 8902 - DNA, 14 bp, Artificial Sequence
  Oligonucleotide probe
  misc_binding (1)..(14): Hybridization probe for the specific detection of mutant HIV-1 at codon 188 of the reverse transcriptase gene.
tgayttrttgtagg

SEQ ID NO: 8903 - DNA, 13 bp, Artificial Sequence
  Oligonucleotide probe
  misc_binding (1)..(13): Hybridization probe for the specific detection of mutant HIV-1 at codon 188 of the reverse transcriptase gene.
atgayttratgta

SEQ ID NO: 8904 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (1)..(1): base is a locked nucleic acid
tgayttrttgtag

SEQ ID NO: 8905 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (2)..(2): base is a locked nucleic acid
atgayttratgta

SEQ ID NO: 8906 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (2)..(2): base is a locked nucleic acid
tgayttrttgtag

SEQ ID NO: 8907 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (1)..(1): base is a locked nucleic acid
atgayttratgta

SEQ ID NO: 8908 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (5)..(5): base is a locked nucleic acid
tgayttrttgtag

SEQ ID NO: 8909 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (3)..(3): base is a locked nucleic acid
atgayttratgta

SEQ ID NO: 8910 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (3)..(3): base is a locked nucleic acid
tgayttrttgtag

SEQ ID NO: 8911 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (5)..(5): base is a locked nucleic acid
atgayttratgta

SEQ ID NO: 8912 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
tgayttrttgtag

SEQ ID NO: 8913 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
atgayttratgta

SEQ ID NO: 8914 - DNA, 14 bp, Artificial Sequence
  Oligonucleotide probe
  misc_binding (1)..(14): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
tgayttrttgtagg

SEQ ID NO: 8915 - DNA, 14 bp, Artificial Sequence
  Oligonucleotide probe
  misc_binding (1)..(14): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
atgayttratgtag

SEQ ID NO: 8916 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (13)..(13): base is a locked nucleic acid
atgayttratgta

SEQ ID NO: 8917 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (13)..(13): base is a locked nucleic acid
tgayttrttgtag

SEQ ID NO: 8918 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
atgayttratgta

SEQ ID NO: 8919 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (7)..(7): base is a locked nucleic acid
  modified_base (8)..(8): base is a locked nucleic acid
  modified_base (9)..(9): base is a locked nucleic acid
tgayttrttgtag

SEQ ID NO: 8920 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (4)..(4): base is a locked nucleic acid
  modified_base (8)..(8): base is a locked nucleic acid
  modified_base (9)..(9): base is a locked nucleic acid
atgayttratgta

SEQ ID NO: 8921 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (5)..(5): base is a locked nucleic acid
  modified_base (8)..(8): base is a locked nucleic acid
  modified_base (9)..(9): base is a locked nucleic acid
tgayttrttgtag

SEQ ID NO: 8922 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (2)..(2): base is a locked nucleic acid
  modified_base (8)..(8): base is a locked nucleic acid
  modified_base (9)..(9): base is a locked nucleic acid
atgayttratgta

SEQ ID NO: 8923 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (6)..(6): base is a locked nucleic acid
  modified_base (8)..(8): base is a locked nucleic acid
  modified_base (9)..(9): base is a locked nucleic acid
tgayttrttgtag

SEQ ID NO: 8924 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (3)..(3): base is a locked nucleic acid
  modified_base (8)..(8): base is a locked nucleic acid
  modified_base (9)..(9): base is a locked nucleic acid
atgayttratgta

SEQ ID NO: 8925 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (2)..(2): base is a locked nucleic acid
  modified_base (8)..(8): base is a locked nucleic acid
  modified_base (9)..(9): base is a locked nucleic acid
tgayttrttgtag

SEQ ID NO: 8926 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (7)..(7): base is a locked nucleic acid
  modified_base (8)..(8): base is a locked nucleic acid
  modified_base (9)..(9): base is a locked nucleic acid
atgayttratgta

SEQ ID NO: 8927 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
tgayttrttgtag

SEQ ID NO: 8928 - DNA, 13 bp, Artificial Sequence
  Oligonucleotide probe
  misc_binding (1)..(13): Hybridization probe for the specific detection of mutant HIV-1 at codon 188 of the reverse transcriptase gene.
  modified_base (8)..(8): base is a locked nucleic acid
  modified_base (9)..(9): base is a locked nucleic acid
atgayttratgta

SEQ ID NO: 8929 - DNA, 15 bp, Artificial Sequence
  Oligonucleotide probe
  misc_binding (1)..(15): Hybridization probe for the specific detection of mutant HIV-1 at codon 188 of the reverse transcriptase gene.
tcctacaagcaaatc

SEQ ID NO: 8930 - DNA, 15 bp, Artificial Sequence
  Oligonucleotide probe
  misc_binding (1)..(15): Hybridization probe for the specific detection of mutant HIV-1 at codon 188 of the reverse transcriptase gene.
tcctacacacaaatc

SEQ ID NO: 8931 - DNA, 15 bp, Artificial Sequence
  Oligonucleotide probe
  misc_binding (1)..(15): Hybridization probe for the specific detection of mutant HIV-1 at codon 188 of the reverse transcriptase gene.
tcctacatgcaaatc

SEQ ID NO: 8932 - DNA, 18 bp, Artificial Sequence
  Oligonucleotide probe
  misc_binding (1)..(18): Hybridization probe for the specific detection of mutant HIV-1 at codon 188 of the reverse transcriptase gene.
atgayttrttgtaggmtc

SEQ ID NO: 8933 - DNA, 18 bp, Artificial Sequence
  Oligonucleotide probe
  misc_binding (1)..(18): Hybridization probe for the specific detection of mutant HIV-1 at codon 188 of the reverse transcriptase gene.
gatgayttratgtaggmt

SEQ ID NO: 8934 - DNA, 17 bp, Artificial Sequence
  Oligonucleotide probe
  misc_binding (1)..(17): Hybridization probe for the specific detection of mutant HIV-1 at codon 188 of the reverse transcriptase gene.
tgayttrttgtaggmtc

SEQ ID NO: 8935 - DNA, 17 bp, Artificial Sequence
  Oligonucleotide probe
  misc_binding (1)..(17): Hybridization probe for the specific detection of mutant HIV-1 at codon 188 of the reverse transcriptase gene.
atgayttratgtaggmt

SEQ ID NO: 8936 - DNA, 15 bp, Artificial Sequence
  Oligonucleotide probe
  misc_binding (1)..(15): Hybridization probe for the specific detection of mutant HIV-1 at codon 188 of the reverse transcriptase gene.
tgayttrttgtaggm

SEQ ID NO: 8937 - DNA, 15 bp, Artificial Sequence
  Oligonucleotide probe
  misc_binding (1)..(15): Hybridization probe for the specific detection of mutant HIV-1 at codon 188 of the reverse transcriptase gene.
atgayttratgtagg

SEQ ID NO: 8938 - DNA, 16 bp, Artificial Sequence
  Oligonucleotide probe
  misc_binding (1)..(16): Hybridization probe for the specific detection of mutant HIV-1 at codon 188 of the reverse transcriptase gene.
atgayttratgtaggm

SEQ ID NO: 8939 - DNA, 13 bp, Artificial Sequence
  Oligonucleotide probe
  misc_binding (1)..(13): Hybridization probe for the specific detection of mutant HIV-1 at codon 188 of the reverse transcriptase gene.
tgayttrttgtag

SEQ ID NO: 8940 - DNA, 13 bp, Artificial Sequence
  Oligonucleotide probe
  misc_binding (1)..(13): Hybridization probe for the specific detection of mutant HIV-1 at codon 188 of the reverse transcriptase gene.
atgayttratgta

SEQ ID NO: 8941 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (14)..(14): base is a locked nucleic acid
trtatgtagmtcwgaytt

SEQ ID NO: 8942 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (12)..(12): base is a locked nucleic acid
trtatgtagmtcwgaytt

SEQ ID NO: 8943 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (11)..(11): base is a locked nucleic acid
ttrtatgtagmtcwgayt

SEQ ID NO: 8944 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (11)..(11): base is a locked nucleic acid
trtatgtagmtcwgaytt

SEQ ID NO: 8945 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (10)..(10): base is a locked nucleic acid
trtatgtagmtcwgaytt

SEQ ID NO: 8946 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (13)..(13): base is a locked nucleic acid
ttrtatgtagmtcwgayt

SEQ ID NO: 8947 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (13)..(13): base is a locked nucleic acid
trtatgtagmtcwgaytt

SEQ ID NO: 8948 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (17)..(17): base is a locked nucleic acid
ttrtatgtagmtcwgayt

SEQ ID NO: 8949 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (15)..(15): base is a locked nucleic acid
trtatgtagmtcwgaytt

SEQ ID NO: 8950 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (16)..(16): base is a locked nucleic acid
trtatgtagmtcwgaytt

SEQ ID NO: 8951 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (15)..(15): base is a locked nucleic acid
ttrtatgtagmtcwgayt

SEQ ID NO: 8952 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (2)..(2): base is a locked nucleic acid
trtatgtagmtcwgaytt

SEQ ID NO: 8953 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (8)..(8): base is a locked nucleic acid
trtatgtagmtcwgaytt

SEQ ID NO: 8954 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
ttrtatgtagmtcwgayt

SEQ ID NO: 8955 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
trtatgtagmtcwgaytt

SEQ ID NO: 8956 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (8)..(8): base is a locked nucleic acid
ttrtatgtagmtcwgayt

SEQ ID NO: 8957 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (4)..(4): base is a locked nucleic acid
trtatgtagmtcwgaytt

SEQ ID NO: 8958 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (6)..(6): base is a locked nucleic acid
trtatgtagmtcwgaytt

SEQ ID NO: 8959 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (4)..(4): base is a locked nucleic acid
ttrtatgtagmtcwgayt

SEQ ID NO: 8960 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (3)..(3): base is a locked nucleic acid
trtatgtagmtcwgaytt

SEQ ID NO: 8961 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (6)..(6): base is a locked nucleic acid
ttrtatgtagmtcwgayt

SEQ ID NO: 8962 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (14)..(14): base is a locked nucleic acid
trtatgtagmtcwgaytt

SEQ ID NO: 8963 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (18)..(18): base is a locked nucleic acid
trtatgtagmtcwgaytt

SEQ ID NO: 8964 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (16)..(16): base is a locked nucleic acid
ttrtatgtagmtcwgayt

SEQ ID NO: 8965 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (12)..(12): base is a locked nucleic acid
trtatgtagmtcwgaytt

SEQ ID NO: 8966 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (16)..(16): base is a locked nucleic acid
trtatgtagmtcwgaytt

SEQ ID NO: 8967 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (15)..(15): base is a locked nucleic acid
ttrtatgtagmtcwgayt

SEQ ID NO: 8968 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (13)..(13): base is a locked nucleic acid
trtatgtagmtcwgaytt

SEQ ID NO: 8969 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (15)..(15): base is a locked nucleic acid
trtatgtagmtcwgaytt

SEQ ID NO: 8970 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (11)..(11): base is a locked nucleic acid
ttrtatgtagmtcwgayt

SEQ ID NO: 8971 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (11)..(11): base is a locked nucleic acid
trtatgtagmtcwgaytt

SEQ ID NO: 8972 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
  modified_base (13)..(13): base is a locked nucleic acid
ttrtatgtagmtcwgayt

SEQ ID NO: 8973 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (7)..(7): base is a locked nucleic acid
  modified_base (9)..(9): base is a locked nucleic acid
  modified_base (10)..(10): base is a locked nucleic acid
trtatgtagmtcwgaytt

SEQ ID NO: 8974 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (5)..(5): base is a locked nucleic acid
  modified_base (9)..(9): base is a locked nucleic acid
  modified_base (10)..(10): base is a locked nucleic acid
trtatgtagmtcwgaytt

SEQ ID NO: 8975 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (2)..(2): base is a locked nucleic acid
  modified_base (9)..(9): base is a locked nucleic acid
  modified_base (10)..(10): base is a locked nucleic acid
ttrtatgtagmtcwgayt

SEQ ID NO: 8976 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (6)..(6): base is a locked nucleic acid
  modified_base (9)..(9): base is a locked nucleic acid
  modified_base (10)..(10): base is a locked nucleic acid
trtatgtagmtcwgaytt

SEQ ID NO: 8977 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (3)..(3): base is a locked nucleic acid
  modified_base (9)..(9): base is a locked nucleic acid
  modified_base (10)..(10): base is a locked nucleic acid
trtatgtagmtcwgaytt

SEQ ID NO: 8978 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (7)..(7): base is a locked nucleic acid
  modified_base (9)..(9): base is a locked nucleic acid
  modified_base (10)..(10): base is a locked nucleic acid
ttrtatgtagmtcwgayt

SEQ ID NO: 8979 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (3)..(3): base is a locked nucleic acid
  modified_base (9)..(9): base is a locked nucleic acid
  modified_base (10)..(10): base is a locked nucleic acid
ttrtatgtagmtcwgayt

SEQ ID NO: 8980 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (4)..(4): base is a locked nucleic acid
  modified_base (9)..(9): base is a locked nucleic acid
  modified_base (10)..(10): base is a locked nucleic acid
trtatgtagmtcwgaytt

SEQ ID NO: 8981 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (10)..(10): base is a locked nucleic acid
ttrtatgtagmtcwgayt

SEQ ID NO: 8982 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
trtatgtagmtcwgaytt

SEQ ID NO: 8983 - DNA, 18 bp, Artificial Sequence
  Oligonucleotide probe
  misc_binding (1)..(18): Hybridization probe for the specific detection of mutant HIV-1 at codon 190 of the reverse transcriptase gene.
  modified_base (9)..(9): base is a locked nucleic acid
  modified_base (10)..(10): base is a locked nucleic acid
ttrtatgtagmtcwgayt

SEQ ID NO: 8984 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (13)..(13): base is a locked nucleic acid
rtatgtagmtcwgaytt

SEQ ID NO: 8985 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (11)..(11): base is a locked nucleic acid
rtatgtagmtcwgaytt

SEQ ID NO: 8986 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (10)..(10): base is a locked nucleic acid
trtatgtagmtcwgayt

SEQ ID NO: 8987 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (10)..(10): base is a locked nucleic acid
rtatgtagmtcwgaytt

SEQ ID NO: 8988 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (9)..(9): base is a locked nucleic acid
rtatgtagmtcwgaytt

SEQ ID NO: 8989 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (12)..(12): base is a locked nucleic acid
trtatgtagmtcwgayt

SEQ ID NO: 8990 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (12)..(12): base is a locked nucleic acid
rtatgtagmtcwgaytt

SEQ ID NO: 8991 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (16)..(16): base is a locked nucleic acid
trtatgtagmtcwgayt

SEQ ID NO: 8992 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (14)..(14): base is a locked nucleic acid
rtatgtagmtcwgaytt

SEQ ID NO: 8993 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (15)..(15): base is a locked nucleic acid
rtatgtagmtcwgaytt

SEQ ID NO: 8994 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (14)..(14): base is a locked nucleic acid
trtatgtagmtcwgayt

SEQ ID NO: 8995 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (1)..(1): base is a locked nucleic acid
rtatgtagmtcwgaytt

SEQ ID NO: 8996 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (7)..(7): base is a locked nucleic acid
rtatgtagmtcwgaytt

SEQ ID NO: 8997 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
trtatgtagmtcwgayt

SEQ ID NO: 8998 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
rtatgtagmtcwgaytt

SEQ ID NO: 8999 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (7)..(7): base is a locked nucleic acid
trtatgtagmtcwgayt

SEQ ID NO: 9000 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (3)..(3): base is a locked nucleic acid
rtatgtagmtcwgaytt

SEQ ID NO: 9001 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (5)..(5): base is a locked nucleic acid
rtatgtagmtcwgaytt

SEQ ID NO: 9002 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (3)..(3): base is a locked nucleic acid
trtatgtagmtcwgayt

SEQ ID NO: 9003 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (2)..(2): base is a locked nucleic acid
rtatgtagmtcwgaytt

SEQ ID NO: 9004 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (5)..(5): base is a locked nucleic acid
trtatgtagmtcwgayt

SEQ ID NO: 9005 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (13)..(13): base is a locked nucleic acid
rtatgtagmtcwgaytt

SEQ ID NO: 9006 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (17)..(17): base is a locked nucleic acid
rtatgtagmtcwgaytt

SEQ ID NO: 9007 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (15)..(15): base is a locked nucleic acid
trtatgtagmtcwgayt

SEQ ID NO: 9008 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (11)..(11): base is a locked nucleic acid
rtatgtagmtcwgaytt

SEQ ID NO: 9009 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (15)..(15): base is a locked nucleic acid
rtatgtagmtcwgaytt

SEQ ID NO: 9010 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (14)..(14): base is a locked nucleic acid
trtatgtagmtcwgayt

SEQ ID NO: 9011 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (12)..(12): base is a locked nucleic acid
rtatgtagmtcwgaytt

SEQ ID NO: 9012 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (14)..(14): base is a locked nucleic acid
rtatgtagmtcwgaytt

SEQ ID NO: 9013 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (10)..(10): base is a locked nucleic acid
trtatgtagmtcwgayt

SEQ ID NO: 9014 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (10)..(10): base is a locked nucleic acid
rtatgtagmtcwgaytt

SEQ ID NO: 9015 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (12)..(12): base is a locked nucleic acid
trtatgtagmtcwgayt

SEQ ID NO: 9016 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (6)..(6): base is a locked nucleic acid
  modified_base (8)..(8): base is a locked nucleic acid
  modified_base (9)..(9): base is a locked nucleic acid
rtatgtagmtcwgaytt

SEQ ID NO: 9017 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (4)..(4): base is a locked nucleic acid
  modified_base (8)..(8): base is a locked nucleic acid
  modified_base (9)..(9): base is a locked nucleic acid
rtatgtagmtcwgaytt

SEQ ID NO: 9018 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (1)..(1): base is a locked nucleic acid
  modified_base (8)..(8): base is a locked nucleic acid
  modified_base (9)..(9): base is a locked nucleic acid
trtatgtagmtcwgayt

SEQ ID NO: 9019 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (5)..(5): base is a locked nucleic acid
  modified_base (8)..(8): base is a locked nucleic acid
  modified_base (9)..(9): base is a locked nucleic acid
rtatgtagmtcwgaytt

SEQ ID NO: 9020 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (2)..(2): base is a locked nucleic acid
  modified_base (8)..(8): base is a locked nucleic acid
  modified_base (9)..(9): base is a locked nucleic acid
rtatgtagmtcwgaytt

SEQ ID NO: 9021 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (6)..(6): base is a locked nucleic acid
  modified_base (8)..(8): base is a locked nucleic acid
  modified_base (9)..(9): base is a locked nucleic acid
trtatgtagmtcwgayt

SEQ ID NO: 9022 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (2)..(2): base is a locked nucleic acid
  modified_base (8)..(8): base is a locked nucleic acid
  modified_base (9)..(9): base is a locked nucleic acid
trtatgtagmtcwgayt

SEQ ID NO: 9023 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (3)..(3): base is a locked nucleic acid
  modified_base (8)..(8): base is a locked nucleic acid
  modified_base (9)..(9): base is a locked nucleic acid
rtatgtagmtcwgaytt

SEQ ID NO: 9024 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (7)..(7): base is a locked nucleic acid
  modified_base (8)..(8): base is a locked nucleic acid
  modified_base (9)..(9): base is a locked nucleic acid
trtatgtagmtcwgayt

SEQ ID NO: 9025 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
rtatgtagmtcwgaytt

SEQ ID NO: 9026 - DNA, 17 bp, Artificial Sequence
  Oligonucleotide probe
  misc_binding (1)..(17): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
trtatgtagmtcwgayt

SEQ ID NO: 9027 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (13)..(13): base is a locked nucleic acid
rtatgtagmtcwgay

SEQ ID NO: 9028 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (11)..(11): base is a locked nucleic acid
rtatgtagmtcwgay

SEQ ID NO: 9029 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (10)..(10): base is a locked nucleic acid
trtatgtagmtcwga

SEQ ID NO: 9030 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (10)..(10): base is a locked nucleic acid
rtatgtagmtcwgay

SEQ ID NO: 9031 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (9)..(9): base is a locked nucleic acid
rtatgtagmtcwgay

SEQ ID NO: 9032 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (12)..(12): base is a locked nucleic acid
trtatgtagmtcwga

SEQ ID NO: 9033 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (12)..(12): base is a locked nucleic acid
rtatgtagmtcwgay

SEQ ID NO: 9034 - DNA, 15 bp, Artificial Sequence
  Oligonucleotide probe
  misc_binding (1)..(15): Hybridization probe for the specific detection of mutant HIV-1 at codon 190 of the reverse transcriptase gene.
trtatgtagmtcwga

SEQ ID NO: 9035 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (14)..(14): base is a locked nucleic acid
rtatgtagmtcwgay

SEQ ID NO: 9036 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (15)..(15): base is a locked nucleic acid
rtatgtagmtcwgay

SEQ ID NO: 9037 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (14)..(14): base is a locked nucleic acid
trtatgtagmtcwga

SEQ ID NO: 9038 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (1)..(1): base is a locked nucleic acid
rtatgtagmtcwgay

SEQ ID NO: 9039 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (7)..(7): base is a locked nucleic acid
rtatgtagmtcwgay

SEQ ID NO: 9040 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
trtatgtagmtcwga

SEQ ID NO: 9041 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
rtatgtagmtcwgay

SEQ ID NO: 9042 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (7)..(7): base is a locked nucleic acid
trtatgtagmtcwga

SEQ ID NO: 9043 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (3)..(3): base is a locked nucleic acid
rtatgtagmtcwgay

SEQ ID NO: 9044 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (5)..(5): base is a locked nucleic acid
rtatgtagmtcwgay

SEQ ID NO: 9045 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (3)..(3): base is a locked nucleic acid
trtatgtagmtcwga

SEQ ID NO: 9046 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (2)..(2): base is a locked nucleic acid
rtatgtagmtcwgay

SEQ ID NO: 9047 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (5)..(5): base is a locked nucleic acid
trtatgtagmtcwga

SEQ ID NO: 9048 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (13)..(13): base is a locked nucleic acid
rtatgtagmtcwgay

SEQ ID NO: 9049 - DNA, 16 bp, Artificial Sequence
  Oligonucleotide probe
  misc_binding (1)..(16): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
rtatgtagmtcwgayt

SEQ ID NO: 9050 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (15)..(15): base is a locked nucleic acid
trtatgtagmtcwga

SEQ ID NO: 9051 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (11)..(11): base is a locked nucleic acid
rtatgtagmtcwgay

SEQ ID NO: 9052 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (15)..(15): base is a locked nucleic acid
rtatgtagmtcwgay

SEQ ID NO: 9053 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (14)..(14): base is a locked nucleic acid
trtatgtagmtcwga

SEQ ID NO: 9054 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (12)..(12): base is a locked nucleic acid
rtatgtagmtcwgay

SEQ ID NO: 9055 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (14)..(14): base is a locked nucleic acid
rtatgtagmtcwgay

SEQ ID NO: 9056 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (10)..(10): base is a locked nucleic acid
trtatgtagmtcwga

SEQ ID NO: 9057 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (10)..(10): base is a locked nucleic acid
rtatgtagmtcwgay

SEQ ID NO: 9058 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (12)..(12): base is a locked nucleic acid
trtatgtagmtcwga

SEQ ID NO: 9059 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (6)..(6): base is a locked nucleic acid
  modified_base (8)..(8): base is a locked nucleic acid
  modified_base (9)..(9): base is a locked nucleic acid
rtatgtagmtcwgay

SEQ ID NO: 9060 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (4)..(4): base is a locked nucleic acid
  modified_base (8)..(8): base is a locked nucleic acid
  modified_base (9)..(9): base is a locked nucleic acid
rtatgtagmtcwgay

SEQ ID NO: 9061 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (1)..(1): base is a locked nucleic acid
  modified_base (8)..(8): base is a locked nucleic acid
  modified_base (9)..(9): base is a locked nucleic acid
trtatgtagmtcwga

SEQ ID NO: 9062 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (5)..(5): base is a locked nucleic acid
  modified_base (8)..(8): base is a locked nucleic acid
  modified_base (9)..(9): base is a locked nucleic acid
rtatgtagmtcwgay

SEQ ID NO: 9063 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (2)..(2): base is a locked nucleic acid
  modified_base (8)..(8): base is a locked nucleic acid
  modified_base (9)..(9): base is a locked nucleic acid
rtatgtagmtcwgay

SEQ ID NO: 9064 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (6)..(6): base is a locked nucleic acid
  modified_base (8)..(8): base is a locked nucleic acid
  modified_base (9)..(9): base is a locked nucleic acid
trtatgtagmtcwga

SEQ ID NO: 9065 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (2)..(2): base is a locked nucleic acid
  modified_base (8)..(8): base is a locked nucleic acid
  modified_base (9)..(9): base is a locked nucleic acid
trtatgtagmtcwga

SEQ ID NO: 9066 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (3)..(3): base is a locked nucleic acid
  modified_base (8)..(8): base is a locked nucleic acid
  modified_base (9)..(9): base is a locked nucleic acid
rtatgtagmtcwgay

SEQ ID NO: 9067 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (7)..(7): base is a locked nucleic acid
  modified_base (8)..(8): base is a locked nucleic acid
  modified_base (9)..(9): base is a locked nucleic acid
trtatgtagmtcwga

SEQ ID NO: 9068 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
rtatgtagmtcwgay

SEQ ID NO: 9069 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
trtatgtagmtcwga

SEQ ID NO: 9070 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (13)..(13): base is a locked nucleic acid
rtatgtagmtcwg

SEQ ID NO: 9071 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (11)..(11): base is a locked nucleic acid
rtatgtagmtcwg

SEQ ID NO: 9072 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (10)..(10): base is a locked nucleic acid
trtatgtagmtcw

SEQ ID NO: 9073 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (10)..(10): base is a locked nucleic acid
rtatgtagmtcwg

SEQ ID NO: 9074 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (9)..(9): base is a locked nucleic acid
rtatgtagmtcwg

SEQ ID NO: 9075 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (12)..(12): base is a locked nucleic acid
trtatgtagmtcw

SEQ ID NO: 9076 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (12)..(12): base is a locked nucleic acid
rtatgtagmtcwg

SEQ ID NO: 9077 - DNA, 14 bp, Artificial Sequence
  Oligonucleotide probe
  misc_binding (1)..(14): Hybridization probe for the specific detection of mutant HIV-1 at codon 190 of the reverse transcriptase gene.
trtatgtagmtcwg

SEQ ID NO: 9078 - DNA, 13 bp, Artificial Sequence
  Oligonucleotide probe
  misc_binding (1)..(13): Hybridization probe for the specific detection of mutant HIV-1 at codon 190 of the reverse transcriptase gene.
rtatgtagmtcwg

SEQ ID NO: 9079 - DNA, 14 bp, Artificial Sequence
  Oligonucleotide probe
  misc_binding (1)..(14): Hybridization probe for the specific detection of mutant HIV-1 at codon 190 of the reverse transcriptase gene.
rtatgtagmtcwga

SEQ ID NO: 9080 - DNA, 13 bp, Artificial Sequence
  Oligonucleotide probe
  misc_binding (1)..(13): Hybridization probe for the specific detection of mutant HIV-1 at codon 190 of the reverse transcriptase gene.
trtatgtagmtcw

SEQ ID NO: 9081 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (1)..(1): base is a locked nucleic acid
rtatgtagmtcwg

SEQ ID NO: 9082 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (7)..(7): base is a locked nucleic acid
rtatgtagmtcwg

SEQ ID NO: 9083 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
trtatgtagmtcw

SEQ ID NO: 9084 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
rtatgtagmtcwg

SEQ ID NO: 9085 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (7)..(7): base is a locked nucleic acid
trtatgtagmtcw

SEQ ID NO: 9086 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (3)..(3): base is a locked nucleic acid
rtatgtagmtcwg

SEQ ID NO: 9087 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (5)..(5): base is a locked nucleic acid
rtatgtagmtcwg

SEQ ID NO: 9088 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (3)..(3): base is a locked nucleic acid
trtatgtagmtcw

SEQ ID NO: 9089 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (2)..(2): base is a locked nucleic acid
rtatgtagmtcwg

SEQ ID NO: 9090 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (5)..(5): base is a locked nucleic acid
trtatgtagmtcw

SEQ ID NO: 9091 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (13)..(13): base is a locked nucleic acid
rtatgtagmtcwg

SEQ ID NO: 9092 - DNA, 14 bp, Artificial Sequence
  Oligonucleotide probe
  misc_binding (1)..(14): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
rtatgtagmtcwga

SEQ ID NO: 9093 - DNA, 14 bp, Artificial Sequence
  Oligonucleotide probe
  misc_binding (1)..(14): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
trtatgtagmtcwg

SEQ ID NO: 9094 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (11)..(11): base is a locked nucleic acid
rtatgtagmtcwg

SEQ ID NO: 9095 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
trtatgtagmtcw

SEQ ID NO: 9096 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (12)..(12): base is a locked nucleic acid
rtatgtagmtcwg

SEQ ID NO: 9097 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
rtatgtagmtcwg

SEQ ID NO: 9098 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (10)..(10): base is a locked nucleic acid
trtatgtagmtcw

SEQ ID NO: 9099 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (10)..(10): base is a locked nucleic acid
rtatgtagmtcwg

SEQ ID NO: 9100 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
  modified_base (12)..(12): base is a locked nucleic acid
trtatgtagmtcw

SEQ ID NO: 9101 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (6)..(6): base is a locked nucleic acid
  modified_base (8)..(8): base is a locked nucleic acid
  modified_base (9)..(9): base is a locked nucleic acid
rtatgtagmtcwg

SEQ ID NO: 9102 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (4)..(4): base is a locked nucleic acid
  modified_base (8)..(8): base is a locked nucleic acid
  modified_base (9)..(9): base is a locked nucleic acid
rtatgtagmtcwg

SEQ ID NO: 9103 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (1)..(1): base is a locked nucleic acid
  modified_base (8)..(8): base is a locked nucleic acid
  modified_base (9)..(9): base is a locked nucleic acid
trtatgtagmtcw

SEQ ID NO: 9104 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (5)..(5): base is a locked nucleic acid
  modified_base (8)..(8): base is a locked nucleic acid
  modified_base (9)..(9): base is a locked nucleic acid
rtatgtagmtcwg

SEQ ID NO: 9105 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (2)..(2): base is a locked nucleic acid
  modified_base (8)..(8): base is a locked nucleic acid
  modified_base (9)..(9): base is a locked nucleic acid
rtatgtagmtcwg

SEQ ID NO: 9106 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (6)..(6): base is a locked nucleic acid
  modified_base (8)..(8): base is a locked nucleic acid
  modified_base (9)..(9): base is a locked nucleic acid
trtatgtagmtcw

SEQ ID NO: 9107 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (2)..(2): base is a locked nucleic acid
  modified_base (8)..(8): base is a locked nucleic acid
  modified_base (9)..(9): base is a locked nucleic acid
trtatgtagmtcw

SEQ ID NO: 9108 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (3)..(3): base is a locked nucleic acid
  modified_base (8)..(8): base is a locked nucleic acid
  modified_base (9)..(9): base is a locked nucleic acid
rtatgtagmtcwg

SEQ ID NO: 9109 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (7)..(7): base is a locked nucleic acid
  modified_base (8)..(8): base is a locked nucleic acid
  modified_base (9)..(9): base is a locked nucleic acid
trtatgtagmtcw

SEQ ID NO: 9110 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
rtatgtagmtcwg

SEQ ID NO: 9111 - DNA, 13 bp, Artificial Sequence
  Oligonucleotide probe
  misc_binding (1)..(13): Hybridization probe for the specific detection of mutant HIV-1 at codon 190 of the reverse transcriptase gene.
  modified_base (8)..(8): base is a locked nucleic acid
  modified_base (9)..(9): base is a locked nucleic acid
trtatgtagmtcw

SEQ ID NO: 9112 - DNA, 15 bp, Artificial Sequence
  Oligonucleotide probe
  misc_binding (1)..(15): Hybridization probe for the specific detection of mutant HIV-1 at codon 190 of the reverse transcriptase gene.
  misc_feature (9)..(9): n is a, c, g, or t
tatgtagcntctgac

SEQ ID NO: 9113 - DNA, 15 bp, Artificial Sequence
  Oligonucleotide probe
  misc_binding (1)..(15): Hybridization probe for the specific detection of mutant HIV-1 at codon 190 of the reverse transcriptase gene.
tatgtaagytctgac

SEQ ID NO: 9114 - DNA, 15 bp, Artificial Sequence
  Oligonucleotide probe
  misc_binding (1)..(15): Hybridization probe for the specific detection of mutant HIV-1 at codon 190 of the reverse transcriptase gene.
tatgtagartctgac

SEQ ID NO: 9115 - DNA, 15 bp, Artificial Sequence
  Oligonucleotide probe
  misc_binding (1)..(15): Hybridization probe for the specific detection of mutant HIV-1 at codon 190 of the reverse transcriptase gene.
tatgtacartctgac

SEQ ID NO: 9116 - DNA, 18 bp, Artificial Sequence
  Oligonucleotide probe
  misc_binding (1)..(18): Hybridization probe for the specific detection of mutant HIV-1 at codon 190 of the reverse transcriptase gene.
trtatgtagmtcwgaytt

SEQ ID NO: 9117 - DNA, 18 bp, Artificial Sequence
  Oligonucleotide probe
  misc_binding (1)..(18): Hybridization probe for the specific detection of mutant HIV-1 at codon 190 of the reverse transcriptase gene.
ttrtatgtagmtcwgayt

SEQ ID NO: 9118 - DNA, 17 bp, Artificial Sequence
  Oligonucleotide probe
  misc_binding (1)..(17): Hybridization probe for the specific detection of mutant HIV-1 at codon 190 of the reverse transcriptase gene.
rtatgtagmtcwgaytt

SEQ ID NO: 9119 - DNA, 17 bp, Artificial Sequence
  Oligonucleotide probe
  misc_binding (1)..(17): Hybridization probe for the specific detection of mutant HIV-1 at codon 190 of the reverse transcriptase gene.
trtatgtagmtcwgayt

SEQ ID NO: 9120 - DNA, 15 bp, Artificial Sequence
  Oligonucleotide probe
  misc_binding (1)..(15): Hybridization probe for the specific detection of mutant HIV-1 at codon 190 of the reverse transcriptase gene.
rtatgtagmtcwgay

SEQ ID NO: 9121 - DNA, 15 bp, Artificial Sequence
  Oligonucleotide probe
  misc_binding (1)..(15): Hybridization probe for the specific detection of mutant HIV-1 at codon 190 of the reverse transcriptase gene.
trtatgtagmtcwga

SEQ ID NO: 9122 - DNA, 16 bp, Artificial Sequence
  Oligonucleotide probe
  misc_binding (1)..(16): Hybridization probe for the specific detection of mutant HIV-1 at codon 190 of the reverse transcriptase gene.
rtatgtagmtcwgayt

SEQ ID NO: 9123 - DNA, 13 bp, Artificial Sequence
  Oligonucleotide probe
  misc_binding (1)..(13): Hybridization probe for the specific detection of mutant HIV-1 at codon 190 of the reverse transcriptase gene.
rtatgtagmtcwg

SEQ ID NO: 9124 - DNA, 13 bp, Artificial Sequence
  Oligonucleotide probe
  misc_binding (1)..(13): Hybridization probe for the specific detection of mutant HIV-1 at codon 190 of the reverse transcriptase gene.
trtatgtagmtcw

SEQ ID NO: 9125 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (12)..(12): base is a locked nucleic acid
mdcayytryrarvtgggg

SEQ ID NO: 9126 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (16)..(16): base is a locked nucleic acid
mdcayytryrarvtgggg

SEQ ID NO: 9127 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (15)..(15): base is a locked nucleic acid
mdcayytryrarvtgggg

SEQ ID NO: 9128 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (14)..(14): base is a locked nucleic acid
mdcayytryrarvtgggg

SEQ ID NO: 9129 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (8)..(8): base is a locked nucleic acid
mdcayytryrarvtgggg

SEQ ID NO: 9130 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (3)..(3): base is a locked nucleic acid
mdcayytryrarvtgggg

SEQ ID NO: 9131 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (9)..(9): base is a locked nucleic acid
mdcayytryrarvtgggg

SEQ ID NO: 9132 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (5)..(5): base is a locked nucleic acid
mdcayytryrarvtgggg

SEQ ID NO: 9133 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (9)..(9): base is a locked nucleic acid
  modified_base (10)..(10): base is a locked nucleic acid
  modified_base (17)..(17): base is a locked nucleic acid
mdcayytryrarvtgggg

SEQ ID NO: 9134 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (9)..(9): base is a locked nucleic acid
  modified_base (10)..(10): base is a locked nucleic acid
  modified_base (13)..(13): base is a locked nucleic acid
mdcayytryrarvtgggg

SEQ ID NO: 9135 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (9)..(9): base is a locked nucleic acid
  modified_base (10)..(10): base is a locked nucleic acid
  modified_base (15)..(15): base is a locked nucleic acid
mdcayytryrarvtgggg

SEQ ID NO: 9136 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (9)..(9): base is a locked nucleic acid
  modified_base (10)..(10): base is a locked nucleic acid
  modified_base (12)..(12): base is a locked nucleic acid
mdcayytryrarvtgggg

SEQ ID NO: 9137 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (10)..(10): base is a locked nucleic acid
mdcayytryrarvtgggg

SEQ ID NO: 9138 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (2)..(2): base is a locked nucleic acid
  modified_base (9)..(9): base is a locked nucleic acid
  modified_base (10)..(10): base is a locked nucleic acid
mdcayytryrarvtgggg

SEQ ID NO: 9139 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (3)..(3): base is a locked nucleic acid
  modified_base (9)..(9): base is a locked nucleic acid
  modified_base (10)..(10): base is a locked nucleic acid
mdcayytryrarvtgggg

SEQ ID NO: 9140 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (4)..(4): base is a locked nucleic acid
  modified_base (9)..(9): base is a locked nucleic acid
  modified_base (10)..(10): base is a locked nucleic acid
mdcayytryrarvtgggg

SEQ ID NO: 9141 - DNA, 18 bp, Artificial Sequence
  Oligonucleotide probe
  misc_binding (1)..(18): Hybridization probe for the specific detection of mutant HIV-1 at codon 210 of the reverse transcriptase gene.
  modified_base (9)..(9): base is a locked nucleic acid
  modified_base (10)..(10): base is a locked nucleic acid
mdcayytryrarvtgggg

SEQ ID NO: 9142 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (11)..(11): base is a locked nucleic acid
dcayytryrarvtgggg

SEQ ID NO: 9143 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (15)..(15): base is a locked nucleic acid
dcayytryrarvtgggg

SEQ ID NO: 9144 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (14)..(14): base is a locked nucleic acid
dcayytryrarvtgggg

SEQ ID NO: 9145 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (13)..(13): base is a locked nucleic acid
dcayytryrarvtgggg

SEQ ID NO: 9146 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (7)..(7): base is a locked nucleic acid
dcayytryrarvtgggg

SEQ ID NO: 9147 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (2)..(2): base is a locked nucleic acid
dcayytryrarvtgggg

SEQ ID NO: 9148 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (8)..(8): base is a locked nucleic acid
dcayytryrarvtgggg

SEQ ID NO: 9149 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (4)..(4): base is a locked nucleic acid
dcayytryrarvtgggg

SEQ ID NO: 9150 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (16)..(16): base is a locked nucleic acid
dcayytryrarvtgggg

SEQ ID NO: 9151 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (12)..(12): base is a locked nucleic acid
dcayytryrarvtgggg

SEQ ID NO: 9152 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (14)..(14): base is a locked nucleic acid
dcayytryrarvtgggg

SEQ ID NO: 9153 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (11)..(11): base is a locked nucleic acid
dcayytryrarvtgggg

SEQ ID NO: 9154 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (7)..(7): base is a locked nucleic acid
  modified_base (8)..(8): base is a locked nucleic acid
  modified_base (9)..(9): base is a locked nucleic acid
dcayytryrarvtgggg

SEQ ID NO: 9155 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (1)..(1): base is a locked nucleic acid
  modified_base (8)..(8): base is a locked nucleic acid
  modified_base (9)..(9): base is a locked nucleic acid
dcayytryrarvtgggg

SEQ ID NO: 9156 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (2)..(2): base is a locked nucleic acid
  modified_base (8)..(8): base is a locked nucleic acid
  modified_base (9)..(9): base is a locked nucleic acid
dcayytryrarvtgggg

SEQ ID NO: 9157 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (3)..(3): base is a locked nucleic acid
  modified_base (8)..(8): base is a locked nucleic acid
  modified_base (9)..(9): base is a locked nucleic acid
dcayytryrarvtgggg

SEQ ID NO: 9158 - DNA, 17 bp, Artificial Sequence
  Oligonucleotide probe
  misc_binding (1)..(17): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
dcayytryrarvtgggg

SEQ ID NO: 9159 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (11)..(11): base is a locked nucleic acid
dcayytryrarvtgg

SEQ ID NO: 9160 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (15)..(15): base is a locked nucleic acid
dcayytryrarvtgg

SEQ ID NO: 9161 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (14)..(14): base is a locked nucleic acid
dcayytryrarvtgg

SEQ ID NO: 9162 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (13)..(13): base is a locked nucleic acid
dcayytryrarvtgg

SEQ ID NO: 9163 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (7)..(7): base is a locked nucleic acid
dcayytryrarvtgg

SEQ ID NO: 9164 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (2)..(2): base is a locked nucleic acid
dcayytryrarvtgg

SEQ ID NO: 9165 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (8)..(8): base is a locked nucleic acid
dcayytryrarvtgg

SEQ ID NO: 9166 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (4)..(4): base is a locked nucleic acid
dcayytryrarvtgg

SEQ ID NO: 9167 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
dcayytryrarvtgg

SEQ ID NO: 9168 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (12)..(12): base is a locked nucleic acid
dcayytryrarvtgg

SEQ ID NO: 9169 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (14)..(14): base is a locked nucleic acid
dcayytryrarvtgg

SEQ ID NO: 9170 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (11)..(11): base is a locked nucleic acid
dcayytryrarvtgg

SEQ ID NO: 9171 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (7)..(7): base is a locked nucleic acid
  modified_base (8)..(8): base is a locked nucleic acid
  modified_base (9)..(9): base is a locked nucleic acid
dcayytryrarvtgg

SEQ ID NO: 9172 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (1)..(1): base is a locked nucleic acid
  modified_base (8)..(8): base is a locked nucleic acid
  modified_base (9)..(9): base is a locked nucleic acid
dcayytryrarvtgg

SEQ ID NO: 9173 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (2)..(2): base is a locked nucleic acid
  modified_base (8)..(8): base is a locked nucleic acid
  modified_base (9)..(9): base is a locked nucleic acid
dcayytryrarvtgg

SEQ ID NO: 9174 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (3)..(3): base is a locked nucleic acid
  modified_base (8)..(8): base is a locked nucleic acid
  modified_base (9)..(9): base is a locked nucleic acid
dcayytryrarvtgg

SEQ ID NO: 9175 - DNA, 15 bp, Artificial Sequence
  Oligonucleotide probe
  misc_binding (1)..(15): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
dcayytryrarvtgg

SEQ ID NO: 9176 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (11)..(11): base is a locked nucleic acid
dcayytryrarvt

SEQ ID NO: 9177 - DNA, 14 bp, Artificial Sequence
  Oligonucleotide probe
  misc_binding (1)..(14): Hybridization probe for the specific detection of mutant HIV-1 at codon 210 of the reverse transcriptase gene.
dcayytryrarvtg

SEQ ID NO: 9178 - DNA, 13 bp, Artificial Sequence
  Oligonucleotide probe
  misc_binding (1)..(13): Hybridization probe for the specific detection of mutant HIV-1 at codon 210 of the reverse transcriptase gene.
dcayytryrarvt

SEQ ID NO: 9179 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (13)..(13): base is a locked nucleic acid
dcayytryrarvt

SEQ ID NO: 9180 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (7)..(7): base is a locked nucleic acid
dcayytryrarvt

SEQ ID NO: 9181 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (2)..(2): base is a locked nucleic acid
dcayytryrarvt

SEQ ID NO: 9182 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (8)..(8): base is a locked nucleic acid
dcayytryrarvt

SEQ ID NO: 9183 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (4)..(4): base is a locked nucleic acid
dcayytryrarvt

SEQ ID NO: 9184 - DNA, 14 bp, Artificial Sequence
  Oligonucleotide probe
  misc_binding (1)..(14): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
dcayytryrarvtg

SEQ ID NO: 9185 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (12)..(12): base is a locked nucleic acid
dcayytryrarvt

SEQ ID NO: 9186 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
dcayytryrarvt

SEQ ID NO: 9187 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
  modified_base (11)..(11): base is a locked nucleic acid
dcayytryrarvt

SEQ ID NO: 9188 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (7)..(7): base is a locked nucleic acid
  modified_base (8)..(8): base is a locked nucleic acid
  modified_base (9)..(9): base is a locked nucleic acid
dcayytryrarvt

SEQ ID NO: 9189 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (1)..(1): base is a locked nucleic acid
  modified_base (8)..(8): base is a locked nucleic acid
  modified_base (9)..(9): base is a locked nucleic acid
dcayytryrarvt

SEQ ID NO: 9190 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (2)..(2): base is a locked nucleic acid
  modified_base (8)..(8): base is a locked nucleic acid
  modified_base (9)..(9): base is a locked nucleic acid
dcayytryrarvt

SEQ ID NO: 9191 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (3)..(3): base is a locked nucleic acid
  modified_base (8)..(8): base is a locked nucleic acid
  modified_base (9)..(9): base is a locked nucleic acid
dcayytryrarvt

SEQ ID NO: 9192 - DNA, 13 bp, Artificial Sequence
  Oligonucleotide probe
  misc_binding (1)..(13): Hybridization probe for the specific detection of mutant HIV-1 at codon 210 of the reverse transcriptase gene.
  modified_base (8)..(8): base is a locked nucleic acid
  modified_base (9)..(9): base is a locked nucleic acid
dcayytryrarvt

SEQ ID NO: 9193 - DNA, 15 bp, Artificial Sequence
  Oligonucleotide probe
  misc_binding (1)..(15): Hybridization probe for the specific detection of mutant HIV-1 at codon 210 of the reverse transcriptase gene.
catctgtggaggtgg

SEQ ID NO: 9194 - DNA, 18 bp, Artificial Sequence
  Oligonucleotide probe
  misc_binding (1)..(18): Hybridization probe for the specific detection of mutant HIV-1 at codon 210 of the reverse transcriptase gene.
mdcayytryrarvtgggg

SEQ ID NO: 9195 - DNA, 17 bp, Artificial Sequence
  Oligonucleotide probe
  misc_binding (1)..(17): Hybridization probe for the specific detection of mutant HIV-1 at codon 210 of the reverse transcriptase gene.
dcayytryrarvtgggg

SEQ ID NO: 9196 - DNA, 15 bp, Artificial Sequence
  Oligonucleotide probe
  misc_binding (1)..(15): Hybridization probe for the specific detection of mutant HIV-1 at codon 210 of the reverse transcriptase gene.
dcayytryrarvtgg

SEQ ID NO: 9197 - DNA, 13 bp, Artificial Sequence
  Oligonucleotide probe
  misc_binding (1)..(13): Hybridization probe for the specific detection of mutant HIV-1 at codon 210 of the reverse transcriptase gene.
dcayytryrarvt

SEQ ID NO: 9198 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (11)..(11): base is a locked nucleic acid
ggggrytywyacaccaga

SEQ ID NO: 9199 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (13)..(13): base is a locked nucleic acid
ggggrytywyacaccaga

SEQ ID NO: 9200 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (10)..(10): base is a locked nucleic acid
ggggrytywyacaccaga

SEQ ID NO: 9201 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (18)..(18): base is a locked nucleic acid
ggggrytywyacaccaga

SEQ ID NO: 9202 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (8)..(8): base is a locked nucleic acid
ggggrytywyacaccaga

SEQ ID NO: 9203 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (5)..(5): base is a locked nucleic acid
ggggrytywyacaccaga

SEQ ID NO: 9204 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (2)..(2): base is a locked nucleic acid
ggggrytywyacaccaga

SEQ ID NO: 9205 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (4)..(4): base is a locked nucleic acid
ggggrytywyacaccaga

SEQ ID NO: 9206 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (9)..(9): base is a locked nucleic acid
  modified_base (10)..(10): base is a locked nucleic acid
  modified_base (12)..(12): base is a locked nucleic acid
ggggrytywyacaccaga

SEQ ID NO: 9207 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (9)..(9): base is a locked nucleic acid
  modified_base (10)..(10): base is a locked nucleic acid
  modified_base (17)..(17): base is a locked nucleic acid
ggggrytywyacaccaga

SEQ ID NO: 9208 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (9)..(9): base is a locked nucleic acid
  modified_base (10)..(10): base is a locked nucleic acid
  modified_base (11)..(11): base is a locked nucleic acid
ggggrytywyacaccaga

SEQ ID NO: 9209 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (9)..(9): base is a locked nucleic acid
  modified_base (10)..(10): base is a locked nucleic acid
  modified_base (13)..(13): base is a locked nucleic acid
ggggrytywyacaccaga

SEQ ID NO: 9210 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (4)..(4): base is a locked nucleic acid
  modified_base (9)..(9): base is a locked nucleic acid
  modified_base (10)..(10): base is a locked nucleic acid
ggggrytywyacaccaga

SEQ ID NO: 9211 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (3)..(3): base is a locked nucleic acid
  modified_base (9)..(9): base is a locked nucleic acid
  modified_base (10)..(10): base is a locked nucleic acid
ggggrytywyacaccaga

SEQ ID NO: 9212 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (6)..(6): base is a locked nucleic acid
  modified_base (9)..(9): base is a locked nucleic acid
  modified_base (10)..(10): base is a locked nucleic acid
ggggrytywyacaccaga

SEQ ID NO: 9213 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (10)..(10): base is a locked nucleic acid
ggggrytywyacaccaga

SEQ ID NO: 9214 - DNA, 18 bp, Artificial Sequence
  Oligonucleotide probe
  misc_binding (1)..(18): Hybridization probe for the specific detection of mutant HIV-1 at codon 215 of the reverse transcriptase gene.
  modified_base (9)..(9): base is a locked nucleic acid
  modified_base (10)..(10): base is a locked nucleic acid
ggggrytywyacaccaga

SEQ ID NO: 9215 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (10)..(10): base is a locked nucleic acid
gggrytywyacaccaga

SEQ ID NO: 9216 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (12)..(12): base is a locked nucleic acid
gggrytywyacaccaga

SEQ ID NO: 9217 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (9)..(9): base is a locked nucleic acid
gggrytywyacaccaga

SEQ ID NO: 9218 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (17)..(17): base is a locked nucleic acid
gggrytywyacaccaga

SEQ ID NO: 9219 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (7)..(7): base is a locked nucleic acid
gggrytywyacaccaga

SEQ ID NO: 9220 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (4)..(4): base is a locked nucleic acid
gggrytywyacaccaga

SEQ ID NO: 9221 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (1)..(1): base is a locked nucleic acid
gggrytywyacaccaga

SEQ ID NO: 9222 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (3)..(3): base is a locked nucleic acid
gggrytywyacaccaga

SEQ ID NO: 9223 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (11)..(11): base is a locked nucleic acid
gggrytywyacaccaga

SEQ ID NO: 9224 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (16)..(16): base is a locked nucleic acid
gggrytywyacaccaga

SEQ ID NO: 9225 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (10)..(10): base is a locked nucleic acid
gggrytywyacaccaga

SEQ ID NO: 9226 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (12)..(12): base is a locked nucleic acid
gggrytywyacaccaga

SEQ ID NO: 9227 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (3)..(3): base is a locked nucleic acid
  modified_base (8)..(8): base is a locked nucleic acid
  modified_base (9)..(9): base is a locked nucleic acid
gggrytywyacaccaga

SEQ ID NO: 9228 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (2)..(2): base is a locked nucleic acid
  modified_base (8)..(8): base is a locked nucleic acid
  modified_base (9)..(9): base is a locked nucleic acid
gggrytywyacaccaga

SEQ ID NO: 9229 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (5)..(5): base is a locked nucleic acid
  modified_base (8)..(8): base is a locked nucleic acid
  modified_base (9)..(9): base is a locked nucleic acid
gggrytywyacaccaga

SEQ ID NO: 9230 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (7)..(7): base is a locked nucleic acid
  modified_base (8)..(8): base is a locked nucleic acid
  modified_base (9)..(9): base is a locked nucleic acid
gggrytywyacaccaga

SEQ ID NO: 9231 - DNA, 17 bp, Artificial Sequence
  Oligonucleotide probe
  misc_binding (1)..(17): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
gggrytywyacaccaga

SEQ ID NO: 9232 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (10)..(10): base is a locked nucleic acid
gggrytywyacacca

SEQ ID NO: 9233 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (12)..(12): base is a locked nucleic acid
gggrytywyacacca

SEQ ID NO: 9234 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (9)..(9): base is a locked nucleic acid
gggrytywyacacca

SEQ ID NO: 9235 - DNA, 16 bp, Artificial Sequence
  Oligonucleotide probe
  misc_binding (1)..(16): Hybridization probe for the specific detection of mutant HIV-1 at codon 215 of the reverse transcriptase gene.
gggrytywyacaccag

SEQ ID NO: 9236 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (7)..(7): base is a locked nucleic acid
gggrytywyacacca

SEQ ID NO: 9237 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (4)..(4): base is a locked nucleic acid
gggrytywyacacca

SEQ ID NO: 9238 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (1)..(1): base is a locked nucleic acid
gggrytywyacacca

SEQ ID NO: 9239 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (3)..(3): base is a locked nucleic acid
gggrytywyacacca

SEQ ID NO: 9240 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (11)..(11): base is a locked nucleic acid
gggrytywyacacca

SEQ ID NO: 9241 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
gggrytywyacacca

SEQ ID NO: 9242 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (10)..(10): base is a locked nucleic acid
gggrytywyacacca

SEQ ID NO: 9243 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (12)..(12): base is a locked nucleic acid
gggrytywyacacca

SEQ ID NO: 9244 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (3)..(3): base is a locked nucleic acid
  modified_base (8)..(8): base is a locked nucleic acid
  modified_base (9)..(9): base is a locked nucleic acid
gggrytywyacacca

SEQ ID NO: 9245 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (2)..(2): base is a locked nucleic acid
  modified_base (8)..(8): base is a locked nucleic acid
  modified_base (9)..(9): base is a locked nucleic acid
gggrytywyacacca

SEQ ID NO: 9246 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (5)..(5): base is a locked nucleic acid
  modified_base (8)..(8): base is a locked nucleic acid
  modified_base (9)..(9): base is a locked nucleic acid
gggrytywyacacca

SEQ ID NO: 9247 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (7)..(7): base is a locked nucleic acid
  modified_base (8)..(8): base is a locked nucleic acid
  modified_base (9)..(9): base is a locked nucleic acid
gggrytywyacacca

SEQ ID NO: 9248 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
gggrytywyacacca

SEQ ID NO: 9249 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (10)..(10): base is a locked nucleic acid
gggrytywyacac

SEQ ID NO: 9250 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (12)..(12): base is a locked nucleic acid
gggrytywyacac

SEQ ID NO: 9251 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (9)..(9): base is a locked nucleic acid
gggrytywyacac

SEQ ID NO: 9252 - DNA, 14 bp, Artificial Sequence
  Oligonucleotide probe
  misc_binding (1)..(14): Hybridization probe for the specific detection of mutant HIV-1 at codon 215 of the reverse transcriptase gene.
gggrytywyacacc

SEQ ID NO: 9253 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (7)..(7): base is a locked nucleic acid
gggrytywyacac

SEQ ID NO: 9254 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (4)..(4): base is a locked nucleic acid
gggrytywyacac

SEQ ID NO: 9255 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (1)..(1): base is a locked nucleic acid
gggrytywyacac

SEQ ID NO: 9256 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (3)..(3): base is a locked nucleic acid
gggrytywyacac

SEQ ID NO: 9257 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (11)..(11): base is a locked nucleic acid
gggrytywyacac

SEQ ID NO: 9258 - DNA, 14 bp, Artificial Sequence
  Oligonucleotide probe
  misc_binding (1)..(14): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
gggrytywyacacc

SEQ ID NO: 9259 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (10)..(10): base is a locked nucleic acid
gggrytywyacac

SEQ ID NO: 9260 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
  modified_base (12)..(12): base is a locked nucleic acid
gggrytywyacac

SEQ ID NO: 9261 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (3)..(3): base is a locked nucleic acid
  modified_base (8)..(8): base is a locked nucleic acid
  modified_base (9)..(9): base is a locked nucleic acid
gggrytywyacac

SEQ ID NO: 9262 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (2)..(2): base is a locked nucleic acid
  modified_base (8)..(8): base is a locked nucleic acid
  modified_base (9)..(9): base is a locked nucleic acid
gggrytywyacac

SEQ ID NO: 9263 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (5)..(5): base is a locked nucleic acid
  modified_base (8)..(8): base is a locked nucleic acid
  modified_base (9)..(9): base is a locked nucleic acid
gggrytywyacac

SEQ ID NO: 9264 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (7)..(7): base is a locked nucleic acid
  modified_base (8)..(8): base is a locked nucleic acid
  modified_base (9)..(9): base is a locked nucleic acid
gggrytywyacac

SEQ ID NO: 9265 - DNA, 13 bp, Artificial Sequence
  Oligonucleotide probe
  misc_binding (1)..(13): Hybridization probe for the specific detection of mutant HIV-1 at codon 215 of the reverse transcriptase gene.
  modified_base (8)..(8): base is a locked nucleic acid
  modified_base (9)..(9): base is a locked nucleic acid
gggrytywyacac

SEQ ID NO: 9266 - DNA, 15 bp, Artificial Sequence
  Oligonucleotide probe
  misc_binding (1)..(15): Hybridization probe for the specific detection of mutant HIV-1 at codon 215 of the reverse transcriptase gene.
tggtgtrtaaaatcc

SEQ ID NO: 9267 - DNA, 15 bp, Artificial Sequence
  Oligonucleotide probe
  misc_binding (1)..(15): Hybridization probe for the specific detection of mutant HIV-1 at codon 215 of the reverse transcriptase gene.
tggtgtraaaaatcc

SEQ ID NO: 9268 - DNA, 15 bp, Artificial Sequence
  Oligonucleotide probe
  misc_binding (1)..(15): Hybridization probe for the specific detection of mutant HIV-1 at codon 215 of the reverse transcriptase gene.
tggtgtrctaaatcc

SEQ ID NO: 9269 - DNA, 15 bp, Artificial Sequence
  Oligonucleotide probe
  misc_binding (1)..(15): Hybridization probe for the specific detection of mutant HIV-1 at codon 215 of the reverse transcriptase gene.
tggtgtrcaaaatcc

SEQ ID NO: 9270 - DNA, 15 bp, Artificial Sequence
  Oligonucleotide probe
  misc_binding (1)..(15): Hybridization probe for the specific detection of mutant HIV-1 at codon 215 of the reverse transcriptase gene.
tggtgtrtcaaatcc

SEQ ID NO: 9271 - DNA, 15 bp, Artificial Sequence
  Oligonucleotide probe
  misc_binding (1)..(15): Hybridization probe for the specific detection of mutant HIV-1 at codon 215 of the reverse transcriptase gene.
tggtgtytcaaatcc

SEQ ID NO: 9272 - DNA, 15 bp, Artificial Sequence
  Oligonucleotide probe
  misc_binding (1)..(15): Hybridization probe for the specific detection of mutant HIV-1 at codon 215 of the reverse transcriptase gene.
tggtgttadaaatcc

SEQ ID NO: 9273 - DNA, 15 bp, Artificial Sequence
  Oligonucleotide probe
  misc_binding (1)..(15): Hybridization probe for the specific detection of mutant HIV-1 at codon 215 of the reverse transcriptase gene.
  misc_feature (7)..(7): n is a, c, g, or t
tggtgtnacaaatcc

SEQ ID NO: 9274 - DNA, 18 bp, Artificial Sequence
  Oligonucleotide probe
  misc_binding (1)..(18): Hybridization probe for the specific detection of mutant HIV-1 at codon 215 of the reverse transcriptase gene.
ggggrytywyacaccaga

SEQ ID NO: 9275 - DNA, 17 bp, Artificial Sequence
  Oligonucleotide probe
  misc_binding (1)..(17): Hybridization probe for the specific detection of mutant HIV-1 at codon 215 of the reverse transcriptase gene.
gggrytywyacaccaga

SEQ ID NO: 9276 - DNA, 15 bp, Artificial Sequence
  Oligonucleotide probe
  misc_binding (1)..(15): Hybridization probe for the specific detection of mutant HIV-1 at codon 215 of the reverse transcriptase gene.
gggrytywyacacca

SEQ ID NO: 9277 - DNA, 13 bp, Artificial Sequence
  Oligonucleotide probe
  misc_binding (1)..(13): Hybridization probe for the specific detection of mutant HIV-1 at codon 215 of the reverse transcriptase gene.
gggrytywyacac

SEQ ID NO: 9278 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (14)..(14): base is a locked nucleic acid
acaccagayaraarcatc

SEQ ID NO: 9279 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (10)..(10): base is a locked nucleic acid
acaccagayaraarcatc

SEQ ID NO: 9280 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (12)..(12): base is a locked nucleic acid
accagayaaaarcatcar

SEQ ID NO: 9281 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (17)..(17): base is a locked nucleic acid
acaccagayaraarcatc

SEQ ID NO: 9282 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (12)..(12): base is a locked nucleic acid
caccagayaraarcatca

SEQ ID NO: 9283 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (11)..(11): base is a locked nucleic acid
acaccagayaraarcatc

SEQ ID NO: 9284 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (12)..(12): base is a locked nucleic acid
acaccagayaraarcatc

SEQ ID NO: 9285 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (18)..(18): base is a locked nucleic acid
accagayaaaarcatcar

SEQ ID NO: 9286 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (16)..(16): base is a locked nucleic acid
caccagayaraarcatca

SEQ ID NO: 9287 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (16)..(16): base is a locked nucleic acid
acaccagayaraarcatc

SEQ ID NO: 9288 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (15)..(15): base is a locked nucleic acid
accagayaaaarcatcar

SEQ ID NO: 9289 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (18)..(18): base is a locked nucleic acid
acaccagayaraarcatc

SEQ ID NO: 9290 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (15)..(15): base is a locked nucleic acid
caccagayaraarcatca

SEQ ID NO: 9291 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (15)..(15): base is a locked nucleic acid
acaccagayaraarcatc

SEQ ID NO: 9292 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (16)..(16): base is a locked nucleic acid
accagayaaaarcatcar

SEQ ID NO: 9293 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (14)..(14): base is a locked nucleic acid
caccagayaraarcatca

SEQ ID NO: 9294 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
acaccagayaraarcatc

SEQ ID NO: 9295 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (2)..(2): base is a locked nucleic acid
acaccagayaraarcatc

SEQ ID NO: 9296 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
accagayaaaarcatcar

SEQ ID NO: 9297 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (8)..(8): base is a locked nucleic acid
caccagayaraarcatca

SEQ ID NO: 9298 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (6)..(6): base is a locked nucleic acid
acaccagayaraarcatc

SEQ ID NO: 9299 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (7)..(7): base is a locked nucleic acid
accagayaaaarcatcar

SEQ ID NO: 9300 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (3)..(3): base is a locked nucleic acid
acaccagayaraarcatc

SEQ ID NO: 9301 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (3)..(3): base is a locked nucleic acid
caccagayaraarcatca

SEQ ID NO: 9302 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (4)..(4): base is a locked nucleic acid
acaccagayaraarcatc

SEQ ID NO: 9303 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (4)..(4): base is a locked nucleic acid
accagayaaaarcatcar

SEQ ID NO: 9304 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
caccagayaraarcatca

SEQ ID NO: 9305 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (5)..(5): base is a locked nucleic acid
acaccagayaraarcatc

SEQ ID NO: 9306 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (7)..(7): base is a locked nucleic acid
acaccagayaraarcatc

SEQ ID NO: 9307 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (6)..(6): base is a locked nucleic acid
accagayaaaarcatcar

SEQ ID NO: 9308 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (8)..(8): base is a locked nucleic acid
acaccagayaraarcatc

SEQ ID NO: 9309 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (5)..(5): base is a locked nucleic acid
caccagayaraarcatca

SEQ ID NO: 9310 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (11)..(11): base is a locked nucleic acid
acaccagayaraarcatc

SEQ ID NO: 9311 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (15)..(15): base is a locked nucleic acid
acaccagayaraarcatc

SEQ ID NO: 9312 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (13)..(13): base is a locked nucleic acid
accagayaaaarcatcar

SEQ ID NO: 9313 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (17)..(17): base is a locked nucleic acid
caccagayaraarcatca

SEQ ID NO: 9314 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (18)..(18): base is a locked nucleic acid
acaccagayaraarcatc

SEQ ID NO: 9315 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (14)..(14): base is a locked nucleic acid
acaccagayaraarcatc

SEQ ID NO: 9316 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (15)..(15): base is a locked nucleic acid
accagayaaaarcatcar

SEQ ID NO: 9317 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (13)..(13): base is a locked nucleic acid
caccagayaraarcatca

SEQ ID NO: 9318 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (13)..(13): base is a locked nucleic acid
acaccagayaraarcatc

SEQ ID NO: 9319 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (18)..(18): base is a locked nucleic acid
accagayaaaarcatcar

SEQ ID NO: 9320 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (15)..(15): base is a locked nucleic acid
caccagayaraarcatca

SEQ ID NO: 9321 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (17)..(17): base is a locked nucleic acid
acaccagayaraarcatc

SEQ ID NO: 9322 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (14)..(14): base is a locked nucleic acid
accagayaaaarcatcar

SEQ ID NO: 9323 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
  modified_base (12)..(12): base is a locked nucleic acid
caccagayaraarcatca

SEQ ID NO: 9324 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (6)..(6): base is a locked nucleic acid
  modified_base (9)..(9): base is a locked nucleic acid
  modified_base (10)..(10): base is a locked nucleic acid
acaccagayaraarcatc

SEQ ID NO: 9325 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (2)..(2): base is a locked nucleic acid
  modified_base (9)..(9): base is a locked nucleic acid
  modified_base (10)..(10): base is a locked nucleic acid
acaccagayaraarcatc

SEQ ID NO: 9326 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (2)..(2): base is a locked nucleic acid
  modified_base (9)..(9): base is a locked nucleic acid
  modified_base (10)..(10): base is a locked nucleic acid
accagayaaaarcatcar

SEQ ID NO: 9327 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (5)..(5): base is a locked nucleic acid
  modified_base (9)..(9): base is a locked nucleic acid
  modified_base (10)..(10): base is a locked nucleic acid
acaccagayaraarcatc

SEQ ID NO: 9328 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (10)..(10): base is a locked nucleic acid
caccagayaraarcatca

SEQ ID NO: 9329 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (10)..(10): base is a locked nucleic acid
accagayaaaarcatcar

SEQ ID NO: 9330 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (4)..(4): base is a locked nucleic acid
  modified_base (9)..(9): base is a locked nucleic acid
  modified_base (10)..(10): base is a locked nucleic acid
acaccagayaraarcatc

SEQ ID NO: 9331 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (2)..(2): base is a locked nucleic acid
  modified_base (9)..(9): base is a locked nucleic acid
  modified_base (10)..(10): base is a locked nucleic acid
caccagayaraarcatca

SEQ ID NO: 9332 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (7)..(7): base is a locked nucleic acid
  modified_base (9)..(9): base is a locked nucleic acid
  modified_base (10)..(10): base is a locked nucleic acid
acaccagayaraarcatc

SEQ ID NO: 9333 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (3)..(3): base is a locked nucleic acid
  modified_base (9)..(9): base is a locked nucleic acid
  modified_base (10)..(10): base is a locked nucleic acid
acaccagayaraarcatc

SEQ ID NO: 9334 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (4)..(4): base is a locked nucleic acid
  modified_base (9)..(9): base is a locked nucleic acid
  modified_base (10)..(10): base is a locked nucleic acid
accagayaaaarcatcar

SEQ ID NO: 9335 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (3)..(3): base is a locked nucleic acid
  modified_base (9)..(9): base is a locked nucleic acid
  modified_base (10)..(10): base is a locked nucleic acid
caccagayaraarcatca

SEQ ID NO: 9336 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (5)..(5): base is a locked nucleic acid
  modified_base (9)..(9): base is a locked nucleic acid
  modified_base (10)..(10): base is a locked nucleic acid
accagayaaaarcatcar

SEQ ID NO: 9337 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (4)..(4): base is a locked nucleic acid
  modified_base (9)..(9): base is a locked nucleic acid
  modified_base (10)..(10): base is a locked nucleic acid
caccagayaraarcatca

SEQ ID NO: 9338 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
acaccagayaraarcatc

SEQ ID NO: 9339 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
accagayaaaarcatcar

SEQ ID NO: 9340 - DNA, 18 bp, Artificial Sequence
  Oligonucleotide probe
  misc_binding (1)..(18): Hybridization probe for the specific detection of mutant HIV-1 at codon 219 of the reverse transcriptase gene.
  modified_base (9)..(9): base is a locked nucleic acid
  modified_base (10)..(10): base is a locked nucleic acid
caccagayaraarcatca

SEQ ID NO: 9341 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (13)..(13): base is a locked nucleic acid
caccagayaraarcatc

SEQ ID NO: 9342 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (9)..(9): base is a locked nucleic acid
caccagayaraarcatc

SEQ ID NO: 9343 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (11)..(11): base is a locked nucleic acid
ccagayaaaarcatcar

SEQ ID NO: 9344 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (16)..(16): base is a locked nucleic acid
caccagayaraarcatc

SEQ ID NO: 9345 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (11)..(11): base is a locked nucleic acid
accagayaraarcatca

SEQ ID NO: 9346 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (10)..(10): base is a locked nucleic acid
caccagayaraarcatc

SEQ ID NO: 9347 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (11)..(11): base is a locked nucleic acid
caccagayaraarcatc

SEQ ID NO: 9348 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (17)..(17): base is a locked nucleic acid
ccagayaaaarcatcar

SEQ ID NO: 9349 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (15)..(15): base is a locked nucleic acid
accagayaraarcatca

SEQ ID NO: 9350 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (15)..(15): base is a locked nucleic acid
caccagayaraarcatc

SEQ ID NO: 9351 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (14)..(14): base is a locked nucleic acid
ccagayaaaarcatcar

SEQ ID NO: 9352 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (17)..(17): base is a locked nucleic acid
caccagayaraarcatc

SEQ ID NO: 9353 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (14)..(14): base is a locked nucleic acid
accagayaraarcatca

SEQ ID NO: 9354 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (14)..(14): base is a locked nucleic acid
caccagayaraarcatc

SEQ ID NO: 9355 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (15)..(15): base is a locked nucleic acid
ccagayaaaarcatcar

SEQ ID NO: 9356 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (13)..(13): base is a locked nucleic acid
accagayaraarcatca

SEQ ID NO: 9357 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
caccagayaraarcatc

SEQ ID NO: 9358 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (1)..(1): base is a locked nucleic acid
caccagayaraarcatc

SEQ ID NO: 9359 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
ccagayaaaarcatcar

SEQ ID NO: 9360 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (7)..(7): base is a locked nucleic acid
accagayaraarcatca

SEQ ID NO: 9361 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (5)..(5): base is a locked nucleic acid
caccagayaraarcatc

SEQ ID NO: 9362 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (6)..(6): base is a locked nucleic acid
ccagayaaaarcatcar

SEQ ID NO: 9363 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (2)..(2): base is a locked nucleic acid
caccagayaraarcatc

SEQ ID NO: 9364 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (2)..(2): base is a locked nucleic acid
accagayaraarcatca

SEQ ID NO: 9365 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (3)..(3): base is a locked nucleic acid
caccagayaraarcatc

SEQ ID NO: 9366 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (3)..(3): base is a locked nucleic acid
ccagayaaaarcatcar

SEQ ID NO: 9367 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
accagayaraarcatca

SEQ ID NO: 9368 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (4)..(4): base is a locked nucleic acid
caccagayaraarcatc

SEQ ID NO: 9369 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (6)..(6): base is a locked nucleic acid
caccagayaraarcatc

SEQ ID NO: 9370 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (5)..(5): base is a locked nucleic acid
ccagayaaaarcatcar

SEQ ID NO: 9371 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (7)..(7): base is a locked nucleic acid
caccagayaraarcatc

SEQ ID NO: 9372 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (4)..(4): base is a locked nucleic acid
accagayaraarcatca

SEQ ID NO: 9373 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (10)..(10): base is a locked nucleic acid
caccagayaraarcatc

SEQ ID NO: 9374 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (14)..(14): base is a locked nucleic acid
caccagayaraarcatc

SEQ ID NO: 9375 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
ccagayaaaarcatcar

SEQ ID NO: 9376 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (16)..(16): base is a locked nucleic acid
accagayaraarcatca

SEQ ID NO: 9377 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (17)..(17): base is a locked nucleic acid
caccagayaraarcatc

SEQ ID NO: 9378 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (13)..(13): base is a locked nucleic acid
caccagayaraarcatc

SEQ ID NO: 9379 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (14)..(14): base is a locked nucleic acid
ccagayaaaarcatcar

SEQ ID NO: 9380 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
accagayaraarcatca

SEQ ID NO: 9381 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
caccagayaraarcatc

SEQ ID NO: 9382 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (17)..(17): base is a locked nucleic acid
ccagayaaaarcatcar

SEQ ID NO: 9383 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (14)..(14): base is a locked nucleic acid
accagayaraarcatca

SEQ ID NO: 9384 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (16)..(16): base is a locked nucleic acid
caccagayaraarcatc

SEQ ID NO: 9385 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (13)..(13): base is a locked nucleic acid
ccagayaaaarcatcar

SEQ ID NO: 9386 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (11)..(11): base is a locked nucleic acid
accagayaraarcatca

SEQ ID NO: 9387 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (5)..(5): base is a locked nucleic acid
  modified_base (8)..(8): base is a locked nucleic acid
  modified_base (9)..(9): base is a locked nucleic acid
caccagayaraarcatc

SEQ ID NO: 9388 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
caccagayaraarcatc

SEQ ID NO: 9389 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
ccagayaaaarcatcar

SEQ ID NO: 9390 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (4)..(4): base is a locked nucleic acid
  modified_base (8)..(8): base is a locked nucleic acid
  modified_base (9)..(9): base is a locked nucleic acid
caccagayaraarcatc

SEQ ID NO: 9391 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (7)..(7): base is a locked nucleic acid
  modified_base (8)..(8): base is a locked nucleic acid
  modified_base (9)..(9): base is a locked nucleic acid
accagayaraarcatca

SEQ ID NO: 9392 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (7)..(7): base is a locked nucleic acid
  modified_base (8)..(8): base is a locked nucleic acid
  modified_base (9)..(9): base is a locked nucleic acid
ccagayaaaarcatcar

SEQ ID NO: 9393 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
caccagayaraarcatc

SEQ ID NO: 9394 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
accagayaraarcatca

SEQ ID NO: 9395 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (6)..(6): base is a locked nucleic acid
  modified_base (8)..(8): base is a locked nucleic acid
  modified_base (9)..(9): base is a locked nucleic acid
caccagayaraarcatc

SEQ ID NO: 9396 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (2)..(2): base is a locked nucleic acid
  modified_base (8)..(8): base is a locked nucleic acid
  modified_base (9)..(9): base is a locked nucleic acid
caccagayaraarcatc

SEQ ID NO: 9397 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
ccagayaaaarcatcar

SEQ ID NO: 9398 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (2)..(2): base is a locked nucleic acid
  modified_base (8)..(8): base is a locked nucleic acid
  modified_base (9)..(9): base is a locked nucleic acid
accagayaraarcatca

SEQ ID NO: 9399 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (4)..(4): base is a locked nucleic acid
  modified_base (8)..(8): base is a locked nucleic acid
  modified_base (9)..(9): base is a locked nucleic acid
ccagayaaaarcatcar

SEQ ID NO: 9400 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
accagayaraarcatca

SEQ ID NO: 9401 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
caccagayaraarcatc

SEQ ID NO: 9402 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
ccagayaaaarcatcar

SEQ ID NO: 9403 - DNA, 17 bp, Artificial Sequence
  Oligonucleotide probe
  misc_binding (1)..(17): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
accagayaraarcatca

SEQ ID NO: 9404 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (13)..(13): base is a locked nucleic acid
caccagayaraarca

SEQ ID NO: 9405 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (9)..(9): base is a locked nucleic acid
caccagayaraarca

SEQ ID NO: 9406 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (11)..(11): base is a locked nucleic acid
ccagayaaaarcatc

SEQ ID NO: 9407 - DNA, 15 bp, Artificial Sequence
  Oligonucleotide probe
  misc_binding (1)..(15): Hybridization probe for the specific detection of mutant HIV-1 at codon 219 of the reverse transcriptase gene.
caccagayaraarca

SEQ ID NO: 9408 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (11)..(11): base is a locked nucleic acid
accagayaraarcat

SEQ ID NO: 9409 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (10)..(10): base is a locked nucleic acid
caccagayaraarca

SEQ ID NO: 9410 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (11)..(11): base is a locked nucleic acid
caccagayaraarca

SEQ ID NO: 9411 - DNA, 16 bp, Artificial Sequence
  Oligonucleotide probe
  misc_binding (1)..(16): Hybridization probe for the specific detection of mutant HIV-1 at codon 219 of the reverse transcriptase gene.
ccagayaaaarcatca

SEQ ID NO: 9412 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (15)..(15): base is a locked nucleic acid
accagayaraarcat

SEQ ID NO: 9413 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (15)..(15): base is a locked nucleic acid
caccagayaraarca

SEQ ID NO: 9414 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (14)..(14): base is a locked nucleic acid
ccagayaaaarcatc

SEQ ID NO: 9415 - DNA, 16 bp, Artificial Sequence
  Oligonucleotide probe
  misc_binding (1)..(16): Hybridization probe for the specific detection of mutant HIV-1 at codon 219 of the reverse transcriptase gene.
caccagayaraarcat

SEQ ID NO: 9416 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (14)..(14): base is a locked nucleic acid
accagayaraarcat

SEQ ID NO: 9417 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (14)..(14): base is a locked nucleic acid
caccagayaraarca

SEQ ID NO: 9418 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (15)..(15): base is a locked nucleic acid
ccagayaaaarcatc

SEQ ID NO: 9419 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (13)..(13): base is a locked nucleic acid
accagayaraarcat

SEQ ID NO: 9420 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
caccagayaraarca

SEQ ID NO: 9421 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (1)..(1): base is a locked nucleic acid
caccagayaraarca

SEQ ID NO: 9422 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
ccagayaaaarcatc

SEQ ID NO: 9423 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (7)..(7): base is a locked nucleic acid
accagayaraarcat

SEQ ID NO: 9424 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (5)..(5): base is a locked nucleic acid
caccagayaraarca

SEQ ID NO: 9425 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (6)..(6): base is a locked nucleic acid
ccagayaaaarcatc

SEQ ID NO: 9426 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (2)..(2): base is a locked nucleic acid
caccagayaraarca

SEQ ID NO: 9427 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (2)..(2): base is a locked nucleic acid
accagayaraarcat

SEQ ID NO: 9428 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (3)..(3): base is a locked nucleic acid
caccagayaraarca

SEQ ID NO: 9429 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (3)..(3): base is a locked nucleic acid
ccagayaaaarcatc

SEQ ID NO: 9430 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
accagayaraarcat

SEQ ID NO: 9431 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (4)..(4): base is a locked nucleic acid
caccagayaraarca

SEQ ID NO: 9432 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (6)..(6): base is a locked nucleic acid
caccagayaraarca

SEQ ID NO: 9433 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (5)..(5): base is a locked nucleic acid
ccagayaaaarcatc

SEQ ID NO: 9434 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (7)..(7): base is a locked nucleic acid
caccagayaraarca

SEQ ID NO: 9435 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (4)..(4): base is a locked nucleic acid
accagayaraarcat

SEQ ID NO: 9436 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (10)..(10): base is a locked nucleic acid
caccagayaraarca

SEQ ID NO: 9437 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (14)..(14): base is a locked nucleic acid
caccagayaraarca

SEQ ID NO: 9438 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
ccagayaaaarcatc

SEQ ID NO: 9439 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
accagayaraarcat

SEQ ID NO: 9440 - DNA, 16 bp, Artificial Sequence
  Oligonucleotide probe
  misc_binding (1)..(16): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
caccagayaraarcat

SEQ ID NO: 9441 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (13)..(13): base is a locked nucleic acid
caccagayaraarca

SEQ ID NO: 9442 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (14)..(14): base is a locked nucleic acid
ccagayaaaarcatc

SEQ ID NO: 9443 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
accagayaraarcat

SEQ ID NO: 9444 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
caccagayaraarca

SEQ ID NO: 9445 - DNA, 16 bp, Artificial Sequence
  Oligonucleotide probe
  misc_binding (1)..(16): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
ccagayaaaarcatca

SEQ ID NO: 9446 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (14)..(14): base is a locked nucleic acid
accagayaraarcat

SEQ ID NO: 9447 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
caccagayaraarca

SEQ ID NO: 9448 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (13)..(13): base is a locked nucleic acid
ccagayaaaarcatc

SEQ ID NO: 9449 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (11)..(11): base is a locked nucleic acid
accagayaraarcat

SEQ ID NO: 9450 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (5)..(5): base is a locked nucleic acid
  modified_base (8)..(8): base is a locked nucleic acid
  modified_base (9)..(9): base is a locked nucleic acid
caccagayaraarca

SEQ ID NO: 9451 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
caccagayaraarca

SEQ ID NO: 9452 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
ccagayaaaarcatc

SEQ ID NO: 9453 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (4)..(4): base is a locked nucleic acid
  modified_base (8)..(8): base is a locked nucleic acid
  modified_base (9)..(9): base is a locked nucleic acid
caccagayaraarca

SEQ ID NO: 9454 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (7)..(7): base is a locked nucleic acid
  modified_base (8)..(8): base is a locked nucleic acid
  modified_base (9)..(9): base is a locked nucleic acid
accagayaraarcat

SEQ ID NO: 9455 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (7)..(7): base is a locked nucleic acid
  modified_base (8)..(8): base is a locked nucleic acid
  modified_base (9)..(9): base is a locked nucleic acid
ccagayaaaarcatc

SEQ ID NO: 9456 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
caccagayaraarca

SEQ ID NO: 9457 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
accagayaraarcat

SEQ ID NO: 9458 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (6)..(6): base is a locked nucleic acid
  modified_base (8)..(8): base is a locked nucleic acid
  modified_base (9)..(9): base is a locked nucleic acid
caccagayaraarca

SEQ ID NO: 9459 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (2)..(2): base is a locked nucleic acid
  modified_base (8)..(8): base is a locked nucleic acid
  modified_base (9)..(9): base is a locked nucleic acid
caccagayaraarca

SEQ ID NO: 9460 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
ccagayaaaarcatc

SEQ ID NO: 9461 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (2)..(2): base is a locked nucleic acid
  modified_base (8)..(8): base is a locked nucleic acid
  modified_base (9)..(9): base is a locked nucleic acid
accagayaraarcat

SEQ ID NO: 9462 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (4)..(4): base is a locked nucleic acid
  modified_base (8)..(8): base is a locked nucleic acid
  modified_base (9)..(9): base is a locked nucleic acid
ccagayaaaarcatc

SEQ ID NO: 9463 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
accagayaraarcat

SEQ ID NO: 9464 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
caccagayaraarca

SEQ ID NO: 9465 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
ccagayaaaarcatc

SEQ ID NO: 9466 - DNA, 15 bp, Artificial Sequence
  Oligonucleotide probe
  misc_binding (1)..(15): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
accagayaraarcat

SEQ ID NO: 9467 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (13)..(13): base is a locked nucleic acid
caccagayaraar

SEQ ID NO: 9468 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (9)..(9): base is a locked nucleic acid
caccagayaraar

SEQ ID NO: 9469 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (11)..(11): base is a locked nucleic acid
ccagayaaaarca

SEQ ID NO: 9470 - DNA, 14 bp, Artificial Sequence
  Oligonucleotide probe
  misc_binding (1)..(14): Hybridization probe for the specific detection of mutant HIV-1 at codon 219 of the reverse transcriptase gene.
caccagayaraarc

SEQ ID NO: 9471 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (11)..(11): base is a locked nucleic acid
accagayaraarc

SEQ ID NO: 9472 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (10)..(10): base is a locked nucleic acid
caccagayaraar

SEQ ID NO: 9473 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (11)..(11): base is a locked nucleic acid
caccagayaraar

SEQ ID NO: 9474 - DNA, 14 bp, Artificial Sequence
  Oligonucleotide probe
  misc_binding (1)..(14): Hybridization probe for the specific detection of mutant HIV-1 at codon 219 of the reverse transcriptase gene.
ccagayaaaarcat

SEQ ID NO: 9475 - DNA, 14 bp, Artificial Sequence
  Oligonucleotide probe
  misc_binding (1)..(14): Hybridization probe for the specific detection of mutant HIV-1 at codon 219 of the reverse transcriptase gene.
accagayaraarca

SEQ ID NO: 9476 - DNA, 13 bp, Artificial Sequence
  Oligonucleotide probe
  misc_binding (1)..(13): Hybridization probe for the specific detection of mutant HIV-1 at codon 219 of the reverse transcriptase gene.
ccagayaaaarca

SEQ ID NO: 9477 - DNA, 13 bp, Artificial Sequence
  Oligonucleotide probe
  misc_binding (1)..(13): Hybridization probe for the specific detection of mutant HIV-1 at codon 219 of the reverse transcriptase gene.
accagayaraarc

SEQ ID NO: 9478 - DNA, 13 bp, Artificial Sequence
  Oligonucleotide probe
  misc_binding (1)..(13): Hybridization probe for the specific detection of mutant HIV-1 at codon 219 of the reverse transcriptase gene.
caccagayaraar

SEQ ID NO: 9479 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (13)..(13): base is a locked nucleic acid
accagayaraarc

SEQ ID NO: 9480 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
caccagayaraar

SEQ ID NO: 9481 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (1)..(1): base is a locked nucleic acid
caccagayaraar

SEQ ID NO: 9482 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
ccagayaaaarca

SEQ ID NO: 9483 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (7)..(7): base is a locked nucleic acid
accagayaraarc

SEQ ID NO: 9484 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (5)..(5): base is a locked nucleic acid
caccagayaraar

SEQ ID NO: 9485 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (6)..(6): base is a locked nucleic acid
ccagayaaaarca

SEQ ID NO: 9486 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (2)..(2): base is a locked nucleic acid
caccagayaraar

SEQ ID NO: 9487 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (2)..(2): base is a locked nucleic acid
accagayaraarc

SEQ ID NO: 9488 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (3)..(3): base is a locked nucleic acid
caccagayaraar

SEQ ID NO: 9489 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (3)..(3): base is a locked nucleic acid
ccagayaaaarca

SEQ ID NO: 9490 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
accagayaraarc

SEQ ID NO: 9491 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (4)..(4): base is a locked nucleic acid
caccagayaraar

SEQ ID NO: 9492 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (6)..(6): base is a locked nucleic acid
caccagayaraar

SEQ ID NO: 9493 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (5)..(5): base is a locked nucleic acid
ccagayaaaarca

SEQ ID NO: 9494 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (7)..(7): base is a locked nucleic acid
caccagayaraar

SEQ ID NO: 9495 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (4)..(4): base is a locked nucleic acid
accagayaraarc

SEQ ID NO: 9496 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (10)..(10): base is a locked nucleic acid
caccagayaraar

SEQ ID NO: 9497 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
caccagayaraar

SEQ ID NO: 9498 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
ccagayaaaarca

SEQ ID NO: 9499 - DNA, 14 bp, Artificial Sequence
  Oligonucleotide probe
  misc_binding (1)..(14): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
accagayaraarca

SEQ ID NO: 9500 - DNA, 14 bp, Artificial Sequence
  Oligonucleotide probe
  misc_binding (1)..(14): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
caccagayaraarc

SEQ ID NO: 9501 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (13)..(13): base is a locked nucleic acid
caccagayaraar

SEQ ID NO: 9502 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
ccagayaaaarca

SEQ ID NO: 9503 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
accagayaraarc

SEQ ID NO: 9504 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (12)..(12): base is a locked nucleic acid
caccagayaraar

SEQ ID NO: 9505 - DNA, 14 bp, Artificial Sequence
  Oligonucleotide probe
  misc_binding (1)..(14): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
ccagayaaaarcat

SEQ ID NO: 9506 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
accagayaraarc

SEQ ID NO: 9507 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (13)..(13): base is a locked nucleic acid
ccagayaaaarca

SEQ ID NO: 9508 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
  modified_base (11)..(11): base is a locked nucleic acid
accagayaraarc

SEQ ID NO: 9509 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (5)..(5): base is a locked nucleic acid
  modified_base (8)..(8): base is a locked nucleic acid
  modified_base (9)..(9): base is a locked nucleic acid
caccagayaraar

SEQ ID NO: 9510 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
caccagayaraar

SEQ ID NO: 9511 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
ccagayaaaarca

SEQ ID NO: 9512 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (4)..(4): base is a locked nucleic acid
  modified_base (8)..(8): base is a locked nucleic acid
  modified_base (9)..(9): base is a locked nucleic acid
caccagayaraar

SEQ ID NO: 9513 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (7)..(7): base is a locked nucleic acid
  modified_base (8)..(8): base is a locked nucleic acid
  modified_base (9)..(9): base is a locked nucleic acid
accagayaraarc

SEQ ID NO: 9514 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (7)..(7): base is a locked nucleic acid
  modified_base (8)..(8): base is a locked nucleic acid
  modified_base (9)..(9): base is a locked nucleic acid
ccagayaaaarca

SEQ ID NO: 9515 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
caccagayaraar

SEQ ID NO: 9516 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (1)..(1): base is a locked nucleic acid
  modified_base (8)..(8): base is a locked nucleic acid
  modified_base (9)..(9): base is a locked nucleic acid
accagayaraarc

SEQ ID NO: 9517 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (6)..(6): base is a locked nucleic acid
  modified_base (8)..(8): base is a locked nucleic acid
  modified_base (9)..(9): base is a locked nucleic acid
caccagayaraar

SEQ ID NO: 9518 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (2)..(2): base is a locked nucleic acid
  modified_base (8)..(8): base is a locked nucleic acid
  modified_base (9)..(9): base is a locked nucleic acid
caccagayaraar

SEQ ID NO: 9519 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
ccagayaaaarca

SEQ ID NO: 9520 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (2)..(2): base is a locked nucleic acid
  modified_base (8)..(8): base is a locked nucleic acid
  modified_base (9)..(9): base is a locked nucleic acid
accagayaraarc

SEQ ID NO: 9521 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (4)..(4): base is a locked nucleic acid
  modified_base (8)..(8): base is a locked nucleic acid
  modified_base (9)..(9): base is a locked nucleic acid
ccagayaaaarca

SEQ ID NO: 9522 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (3)..(3): base is a locked nucleic acid
  modified_base (8)..(8): base is a locked nucleic acid
  modified_base (9)..(9): base is a locked nucleic acid
accagayaraarc

SEQ ID NO: 9523 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
caccagayaraar

SEQ ID NO: 9524 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
ccagayaaaarca

SEQ ID NO: 9525 - DNA, 13 bp, Artificial Sequence
  Oligonucleotide probe
  misc_binding (1)..(13): Hybridization probe for the specific detection of mutant HIV-1 at codon 219 of the reverse transcriptase gene.
  modified_base (8)..(8): base is a locked nucleic acid
  modified_base (9)..(9): base is a locked nucleic acid
accagayaraarc

SEQ ID NO: 9526 - DNA, 15 bp, Artificial Sequence
  Oligonucleotide probe
  misc_binding (1)..(15): Hybridization probe for the specific detection of mutant HIV-1 at codon 219 of the reverse transcriptase gene.
ccagaccaraaacat

SEQ ID NO: 9527 - DNA, 15 bp, Artificial Sequence
  Oligonucleotide probe
  misc_binding (1)..(15): Hybridization probe for the specific detection of mutant HIV-1 at codon 219 of the reverse transcriptase gene.
ccagacgaraaacat

SEQ ID NO: 9528 - DNA, 15 bp, Artificial Sequence
  Oligonucleotide probe
  misc_binding (1)..(15): Hybridization probe for the specific detection of mutant HIV-1 at codon 219 of the reverse transcriptase gene.
ccagacaayaaacat

SEQ ID NO: 9529 - DNA, 15 bp, Artificial Sequence
  Oligonucleotide probe
  misc_binding (1)..(15): Hybridization probe for the specific detection of mutant HIV-1 at codon 219 of the reverse transcriptase gene.
ccagacmgraaacat

SEQ ID NO: 9530 - DNA, 18 bp, Artificial Sequence
  Oligonucleotide probe
  misc_binding (1)..(18): Hybridization probe for the specific detection of mutant HIV-1 at codon 219 of the reverse transcriptase gene.
acaccagayaraarcatc

SEQ ID NO: 9531 - DNA, 18 bp, Artificial Sequence
  Oligonucleotide probe
  misc_binding (1)..(18): Hybridization probe for the specific detection of mutant HIV-1 at codon 219 of the reverse transcriptase gene.
accagayaaaarcatcar

SEQ ID NO: 9532 - DNA, 18 bp, Artificial Sequence
  Oligonucleotide probe
  misc_binding (1)..(18): Hybridization probe for the specific detection of mutant HIV-1 at codon 219 of the reverse transcriptase gene.
caccagayaraarcatca

SEQ ID NO: 9533 - DNA, 17 bp, Artificial Sequence
  Oligonucleotide probe
  misc_binding (1)..(17): Hybridization probe for the specific detection of mutant HIV-1 at codon 219 of the reverse transcriptase gene.
caccagayaraarcatc

SEQ ID NO: 9534 - DNA, 17 bp, Artificial Sequence
  Oligonucleotide probe
  misc_binding (1)..(17): Hybridization probe for the specific detection of mutant HIV-1 at codon 219 of the reverse transcriptase gene.
ccagayaaaarcatcar

SEQ ID NO: 9535 - DNA, 17 bp, Artificial Sequence
  Oligonucleotide probe
  misc_binding (1)..(17): Hybridization probe for the specific detection of mutant HIV-1 at codon 219 of the reverse transcriptase gene.
accagayaraarcatca

SEQ ID NO: 9536 - DNA, 15 bp, Artificial Sequence
  Oligonucleotide probe
  misc_binding (1)..(15): Hybridization probe for the specific detection of mutant HIV-1 at codon 219 of the reverse transcriptase gene.
caccagayaraarca

SEQ ID NO: 9537 - DNA, 15 bp, Artificial Sequence
  Oligonucleotide probe
  misc_binding (1)..(15): Hybridization probe for the specific detection of mutant HIV-1 at codon 219 of the reverse transcriptase gene.
ccagayaaaarcatc

SEQ ID NO: 9538 - DNA, 15 bp, Artificial Sequence
  Oligonucleotide probe
  misc_binding (1)..(15): Hybridization probe for the specific detection of mutant HIV-1 at codon 219 of the reverse transcriptase gene.
accagayaraarcat

SEQ ID NO: 9539 - DNA, 13 bp, Artificial Sequence
  Oligonucleotide probe
  misc_binding (1)..(13): Hybridization probe for the specific detection of mutant HIV-1 at codon 219 of the reverse transcriptase gene.
caccagayaraar

SEQ ID NO: 9540 - DNA, 13 bp, Artificial Sequence
  Oligonucleotide probe
  misc_binding (1)..(13): Hybridization probe for the specific detection of mutant HIV-1 at codon 219 of the reverse transcriptase gene.
ccagayaaaarca

SEQ ID NO: 9541 - DNA, 13 bp, Artificial Sequence
  Oligonucleotide probe
  misc_binding (1)..(13): Hybridization probe for the specific detection of mutant HIV-1 at codon 219 of the reverse transcriptase gene.
accagayaraarc

SEQ ID NO: 9542 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (17)..(17): base is a locked nucleic acid
araargaacyccattyct

SEQ ID NO: 9543 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (12)..(12): base is a locked nucleic acid
araargaacyccattyct

SEQ ID NO: 9544 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (11)..(11): base is a locked nucleic acid
araargaacyccattyct

SEQ ID NO: 9545 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (10)..(10): base is a locked nucleic acid
araargaacyccattyct

SEQ ID NO: 9546 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (2)..(2): base is a locked nucleic acid
araargaacyccattyct

SEQ ID NO: 9547 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (3)..(3): base is a locked nucleic acid
araargaacyccattyct

SEQ ID NO: 9548 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (7)..(7): base is a locked nucleic acid
araargaacyccattyct

SEQ ID NO: 9549 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (9)..(9): base is a locked nucleic acid
araargaacyccattyct

SEQ ID NO: 9550 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (9)..(9): base is a locked nucleic acid
  modified_base (10)..(10): base is a locked nucleic acid
  modified_base (15)..(15): base is a locked nucleic acid
araargaacyccattyct

SEQ ID NO: 9551 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (9)..(9): base is a locked nucleic acid
  modified_base (10)..(10): base is a locked nucleic acid
  modified_base (11)..(11): base is a locked nucleic acid
araargaacyccattyct

SEQ ID NO: 9552 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (9)..(9): base is a locked nucleic acid
  modified_base (10)..(10): base is a locked nucleic acid
  modified_base (18)..(18): base is a locked nucleic acid
araargaacyccattyct

SEQ ID NO: 9553 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (9)..(9): base is a locked nucleic acid
  modified_base (10)..(10): base is a locked nucleic acid
  modified_base (12)..(12): base is a locked nucleic acid
araargaacyccattyct

SEQ ID NO: 9554 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (6)..(6): base is a locked nucleic acid
  modified_base (9)..(9): base is a locked nucleic acid
  modified_base (10)..(10): base is a locked nucleic acid
araargaacyccattyct

SEQ ID NO: 9555 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (4)..(4): base is a locked nucleic acid
  modified_base (9)..(9): base is a locked nucleic acid
  modified_base (10)..(10): base is a locked nucleic acid
araargaacyccattyct

SEQ ID NO: 9556 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (7)..(7): base is a locked nucleic acid
  modified_base (9)..(9): base is a locked nucleic acid
  modified_base (10)..(10): base is a locked nucleic acid
araargaacyccattyct

SEQ ID NO: 9557 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (10)..(10): base is a locked nucleic acid
araargaacyccattyct

SEQ ID NO: 9558 - DNA, 18 bp, Artificial Sequence
  Oligonucleotide probe
  misc_binding (1)..(18): Hybridization probe for the specific detection of mutant HIV-1 at codon 225 of the reverse transcriptase gene.
  modified_base (9)..(9): base is a locked nucleic acid
  modified_base (10)..(10): base is a locked nucleic acid
araargaacyccattyct

SEQ ID NO: 9559 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (16)..(16): base is a locked nucleic acid
raargaacyccattyct

SEQ ID NO: 9560 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (11)..(11): base is a locked nucleic acid
raargaacyccattyct

SEQ ID NO: 9561 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (10)..(10): base is a locked nucleic acid
raargaacyccattyct

SEQ ID NO: 9562 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (9)..(9): base is a locked nucleic acid
raargaacyccattyct

SEQ ID NO: 9563 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (1)..(1): base is a locked nucleic acid
raargaacyccattyct

SEQ ID NO: 9564 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (2)..(2): base is a locked nucleic acid
raargaacyccattyct

SEQ ID NO: 9565 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (6)..(6): base is a locked nucleic acid
raargaacyccattyct

SEQ ID NO: 9566 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (8)..(8): base is a locked nucleic acid
raargaacyccattyct

SEQ ID NO: 9567 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (14)..(14): base is a locked nucleic acid
raargaacyccattyct

SEQ ID NO: 9568 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (10)..(10): base is a locked nucleic acid
raargaacyccattyct

SEQ ID NO: 9569 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (17)..(17): base is a locked nucleic acid
raargaacyccattyct

SEQ ID NO: 9570 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (11)..(11): base is a locked nucleic acid
raargaacyccattyct

SEQ ID NO: 9571 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (5)..(5): base is a locked nucleic acid
  modified_base (8)..(8): base is a locked nucleic acid
  modified_base (9)..(9): base is a locked nucleic acid
raargaacyccattyct

SEQ ID NO: 9572 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (3)..(3): base is a locked nucleic acid
  modified_base (8)..(8): base is a locked nucleic acid
  modified_base (9)..(9): base is a locked nucleic acid
raargaacyccattyct

SEQ ID NO: 9573 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (6)..(6): base is a locked nucleic acid
  modified_base (8)..(8): base is a locked nucleic acid
  modified_base (9)..(9): base is a locked nucleic acid
raargaacyccattyct

SEQ ID NO: 9574 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (7)..(7): base is a locked nucleic acid
  modified_base (8)..(8): base is a locked nucleic acid
  modified_base (9)..(9): base is a locked nucleic acid
raargaacyccattyct

SEQ ID NO: 9575 - DNA, 17 bp, Artificial Sequence
  Oligonucleotide probe
  misc_binding (1)..(17): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
raargaacyccattyct

SEQ ID NO: 9576 - DNA, 15 bp, Artificial Sequence
  Oligonucleotide probe
  misc_binding (1)..(15): Hybridization probe for the specific detection of mutant HIV-1 at codon 225 of the reverse transcriptase gene.
raargaacyccatty

SEQ ID NO: 9577 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (11)..(11): base is a locked nucleic acid
raargaacyccatty

SEQ ID NO: 9578 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (10)..(10): base is a locked nucleic acid
raargaacyccatty

SEQ ID NO: 9579 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (9)..(9): base is a locked nucleic acid
raargaacyccatty

SEQ ID NO: 9580 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (1)..(1): base is a locked nucleic acid
raargaacyccatty

SEQ ID NO: 9581 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (2)..(2): base is a locked nucleic acid
raargaacyccatty

SEQ ID NO: 9582 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (6)..(6): base is a locked nucleic acid
raargaacyccatty

SEQ ID NO: 9583 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (8)..(8): base is a locked nucleic acid
raargaacyccatty

SEQ ID NO: 9584 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (14)..(14): base is a locked nucleic acid
raargaacyccatty

SEQ ID NO: 9585 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (10)..(10): base is a locked nucleic acid
raargaacyccatty

SEQ ID NO: 9586 - DNA, 16 bp, Artificial Sequence
  Oligonucleotide probe
  misc_binding (1)..(16): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
raargaacyccattyc

SEQ ID NO: 9587 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (11)..(11): base is a locked nucleic acid
raargaacyccatty

SEQ ID NO: 9588 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (5)..(5): base is a locked nucleic acid
  modified_base (8)..(8): base is a locked nucleic acid
  modified_base (9)..(9): base is a locked nucleic acid
raargaacyccatty

SEQ ID NO: 9589 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (3)..(3): base is a locked nucleic acid
  modified_base (8)..(8): base is a locked nucleic acid
  modified_base (9)..(9): base is a locked nucleic acid
raargaacyccatty

SEQ ID NO: 9590 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (6)..(6): base is a locked nucleic acid
  modified_base (8)..(8): base is a locked nucleic acid
  modified_base (9)..(9): base is a locked nucleic acid
raargaacyccatty

SEQ ID NO: 9591 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (7)..(7): base is a locked nucleic acid
  modified_base (8)..(8): base is a locked nucleic acid
  modified_base (9)..(9): base is a locked nucleic acid
raargaacyccatty

SEQ ID NO: 9592 - DNA, 15 bp, Artificial Sequence
  Oligonucleotide probe
  misc_binding (1)..(15): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
raargaacyccatty

SEQ ID NO: 9593 - DNA, 14 bp, Artificial Sequence
  Oligonucleotide probe
  misc_binding (1)..(14): Hybridization probe for the specific detection of mutant HIV-1 at codon 225 of the reverse transcriptase gene.
raargaacyccatt

SEQ ID NO: 9594 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (11)..(11): base is a locked nucleic acid
raargaacyccat

SEQ ID NO: 9595 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (10)..(10): base is a locked nucleic acid
raargaacyccat

SEQ ID NO: 9596 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (9)..(9): base is a locked nucleic acid
raargaacyccat

SEQ ID NO: 9597 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (1)..(1): base is a locked nucleic acid
raargaacyccat

SEQ ID NO: 9598 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (2)..(2): base is a locked nucleic acid
raargaacyccat

SEQ ID NO: 9599 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (6)..(6): base is a locked nucleic acid
raargaacyccat

SEQ ID NO: 9600 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (8)..(8): base is a locked nucleic acid
raargaacyccat

SEQ ID NO: 9601 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
raargaacyccat

SEQ ID NO: 9602 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (10)..(10): base is a locked nucleic acid
raargaacyccat

SEQ ID NO: 9603 - DNA, 14 bp, Artificial Sequence
  Oligonucleotide probe
  misc_binding (1)..(14): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
raargaacyccatt

SEQ ID NO: 9604 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
  modified_base (11)..(11): base is a locked nucleic acid
raargaacyccat

SEQ ID NO: 9605 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (5)..(5): base is a locked nucleic acid
  modified_base (8)..(8): base is a locked nucleic acid
  modified_base (9)..(9): base is a locked nucleic acid
raargaacyccat

SEQ ID NO: 9606 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (3)..(3): base is a locked nucleic acid
  modified_base (8)..(8): base is a locked nucleic acid
  modified_base (9)..(9): base is a locked nucleic acid
raargaacyccat

SEQ ID NO: 9607 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (6)..(6): base is a locked nucleic acid
  modified_base (8)..(8): base is a locked nucleic acid
  modified_base (9)..(9): base is a locked nucleic acid
raargaacyccat

SEQ ID NO: 9608 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (7)..(7): base is a locked nucleic acid
  modified_base (8)..(8): base is a locked nucleic acid
  modified_base (9)..(9): base is a locked nucleic acid
raargaacyccat

SEQ ID NO: 9609 - DNA, 13 bp, Artificial Sequence
  Oligonucleotide probe
  misc_binding (1)..(13): Hybridization probe for the specific detection of mutant HIV-1 at codon 225 of the reverse transcriptase gene.
  modified_base (8)..(8): base is a locked nucleic acid
  modified_base (9)..(9): base is a locked nucleic acid
raargaacyccat

SEQ ID NO: 9610 - DNA, 15 bp, Artificial Sequence
  Oligonucleotide probe
  misc_binding (1)..(15): Hybridization probe for the specific detection of mutant HIV-1 at codon 225 of the reverse transcriptase gene.
aaagaacayccattc

SEQ ID NO: 9611 - DNA, 18 bp, Artificial Sequence
  Oligonucleotide probe
  misc_binding (1)..(18): Hybridization probe for the specific detection of mutant HIV-1 at codon 225 of the reverse transcriptase gene.
araargaacyccattyct

SEQ ID NO: 9612 - DNA, 17 bp, Artificial Sequence
  Oligonucleotide probe
  misc_binding (1)..(17): Hybridization probe for the specific detection of mutant HIV-1 at codon 225 of the reverse transcriptase gene.
raargaacyccattyct

SEQ ID NO: 9613 - DNA, 15 bp, Artificial Sequence
  Oligonucleotide probe
  misc_binding (1)..(15): Hybridization probe for the specific detection of mutant HIV-1 at codon 225 of the reverse transcriptase gene.
raargaacyccatty

SEQ ID NO: 9614 - DNA, 16 bp, Artificial Sequence
  Oligonucleotide probe
  misc_binding (1)..(16): Hybridization probe for the specific detection of mutant HIV-1 at codon 225 of the reverse transcriptase gene.
raargaacyccattyc

SEQ ID NO: 9615 - DNA, 13 bp, Artificial Sequence
  Oligonucleotide probe
  misc_binding (1)..(13): Hybridization probe for the specific detection of mutant HIV-1 at codon 225 of the reverse transcriptase gene.
raargaacyccat

SEQ ID NO: 9616 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (11)..(11): base is a locked nucleic acid
gaaccyccatyctttgga

SEQ ID NO: 9617 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (11)..(11): base is a locked nucleic acid
aaccyccatyctttggat

SEQ ID NO: 9618 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (13)..(13): base is a locked nucleic acid
gaaccyccatyctttgga

SEQ ID NO: 9619 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (14)..(14): base is a locked nucleic acid
aaccyccatyctttggat

SEQ ID NO: 9620 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (16)..(16): base is a locked nucleic acid
gaaccyccatyctttgga

SEQ ID NO: 9621 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (17)..(17): base is a locked nucleic acid
aaccyccatyctttggat

SEQ ID NO: 9622 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (14)..(14): base is a locked nucleic acid
gaaccyccatyctttgga

SEQ ID NO: 9623 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (15)..(15): base is a locked nucleic acid
aaccyccatyctttggat

SEQ ID NO: 9624 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (4)..(4): base is a locked nucleic acid
gaaccyccatyctttgga

SEQ ID NO: 9625 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (5)..(5): base is a locked nucleic acid
aaccyccatyctttggat

SEQ ID NO: 9626 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (3)..(3): base is a locked nucleic acid
gaaccyccatyctttgga

SEQ ID NO: 9627 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (7)..(7): base is a locked nucleic acid
aaccyccatyctttggat

SEQ ID NO: 9628 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (7)..(7): base is a locked nucleic acid
gaaccyccatyctttgga

SEQ ID NO: 9629 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (2)..(2): base is a locked nucleic acid
aaccyccatyctttggat

SEQ ID NO: 9630 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (8)..(8): base is a locked nucleic acid
gaaccyccatyctttgga

SEQ ID NO: 9631 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
aaccyccatyctttggat

SEQ ID NO: 9632 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (11)..(11): base is a locked nucleic acid
gaaccyccatyctttgga

SEQ ID NO: 9633 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (16)..(16): base is a locked nucleic acid
aaccyccatyctttggat

SEQ ID NO: 9634 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (14)..(14): base is a locked nucleic acid
gaaccyccatyctttgga

SEQ ID NO: 9635 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (17)..(17): base is a locked nucleic acid
aaccyccatyctttggat

SEQ ID NO: 9636 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (13)..(13): base is a locked nucleic acid
gaaccyccatyctttgga

SEQ ID NO: 9637 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (13)..(13): base is a locked nucleic acid
aaccyccatyctttggat

SEQ ID NO: 9638 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (15)..(15): base is a locked nucleic acid
gaaccyccatyctttgga

SEQ ID NO: 9639 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
  modified_base (12)..(12): base is a locked nucleic acid
aaccyccatyctttggat

SEQ ID NO: 9640 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (10)..(10): base is a locked nucleic acid
gaaccyccatyctttgga

SEQ ID NO: 9641 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (5)..(5): base is a locked nucleic acid
  modified_base (9)..(9): base is a locked nucleic acid
  modified_base (10)..(10): base is a locked nucleic acid
aaccyccatyctttggat

SEQ ID NO: 9642 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (7)..(7): base is a locked nucleic acid
  modified_base (9)..(9): base is a locked nucleic acid
  modified_base (10)..(10): base is a locked nucleic acid
gaaccyccatyctttgga

SEQ ID NO: 9643 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (4)..(4): base is a locked nucleic acid
  modified_base (9)..(9): base is a locked nucleic acid
  modified_base (10)..(10): base is a locked nucleic acid
aaccyccatyctttggat

SEQ ID NO: 9644 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (4)..(4): base is a locked nucleic acid
  modified_base (9)..(9): base is a locked nucleic acid
  modified_base (10)..(10): base is a locked nucleic acid
gaaccyccatyctttgga

SEQ ID NO: 9645 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (2)..(2): base is a locked nucleic acid
  modified_base (9)..(9): base is a locked nucleic acid
  modified_base (10)..(10): base is a locked nucleic acid
aaccyccatyctttggat

SEQ ID NO: 9646 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (3)..(3): base is a locked nucleic acid
  modified_base (9)..(9): base is a locked nucleic acid
  modified_base (10)..(10): base is a locked nucleic acid
gaaccyccatyctttgga

SEQ ID NO: 9647 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (10)..(10): base is a locked nucleic acid
aaccyccatyctttggat

SEQ ID NO: 9648 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
gaaccyccatyctttgga

SEQ ID NO: 9649 - DNA, 18 bp, Artificial Sequence
  Oligonucleotide probe
  misc_binding (1)..(18): Hybridization probe for the specific detection of mutant HIV-1 at codon 227 of the reverse transcriptase gene.
  modified_base (9)..(9): base is a locked nucleic acid
  modified_base (10)..(10): base is a locked nucleic acid
aaccyccatyctttggat

SEQ ID NO: 9650 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (10)..(10): base is a locked nucleic acid
aaccyccatyctttgga

SEQ ID NO: 9651 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (10)..(10): base is a locked nucleic acid
accyccatyctttggat

SEQ ID NO: 9652 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (12)..(12): base is a locked nucleic acid
aaccyccatyctttgga

SEQ ID NO: 9653 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (13)..(13): base is a locked nucleic acid
accyccatyctttggat

SEQ ID NO: 9654 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (15)..(15): base is a locked nucleic acid
aaccyccatyctttgga

SEQ ID NO: 9655 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (16)..(16): base is a locked nucleic acid
accyccatyctttggat

SEQ ID NO: 9656 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (13)..(13): base is a locked nucleic acid
aaccyccatyctttgga

SEQ ID NO: 9657 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (14)..(14): base is a locked nucleic acid
accyccatyctttggat

SEQ ID NO: 9658 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (3)..(3): base is a locked nucleic acid
aaccyccatyctttgga

SEQ ID NO: 9659 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (4)..(4): base is a locked nucleic acid
accyccatyctttggat

SEQ ID NO: 9660 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (2)..(2): base is a locked nucleic acid
aaccyccatyctttgga

SEQ ID NO: 9661 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (6)..(6): base is a locked nucleic acid
accyccatyctttggat

SEQ ID NO: 9662 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (6)..(6): base is a locked nucleic acid
aaccyccatyctttgga

SEQ ID NO: 9663 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (1)..(1): base is a locked nucleic acid
accyccatyctttggat

SEQ ID NO: 9664 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (7)..(7): base is a locked nucleic acid
aaccyccatyctttgga

SEQ ID NO: 9665 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
accyccatyctttggat

SEQ ID NO: 9666 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (10)..(10): base is a locked nucleic acid
aaccyccatyctttgga

SEQ ID NO: 9667 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (15)..(15): base is a locked nucleic acid
accyccatyctttggat

SEQ ID NO: 9668 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (13)..(13): base is a locked nucleic acid
aaccyccatyctttgga

SEQ ID NO: 9669 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (16)..(16): base is a locked nucleic acid
accyccatyctttggat

SEQ ID NO: 9670 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (12)..(12): base is a locked nucleic acid
aaccyccatyctttgga

SEQ ID NO: 9671 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (12)..(12): base is a locked nucleic acid
accyccatyctttggat

SEQ ID NO: 9672 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (14)..(14): base is a locked nucleic acid
aaccyccatyctttgga

SEQ ID NO: 9673 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (11)..(11): base is a locked nucleic acid
accyccatyctttggat

SEQ ID NO: 9674 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (7)..(7): base is a locked nucleic acid
  modified_base (8)..(8): base is a locked nucleic acid
  modified_base (9)..(9): base is a locked nucleic acid
aaccyccatyctttgga

SEQ ID NO: 9675 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (4)..(4): base is a locked nucleic acid
  modified_base (8)..(8): base is a locked nucleic acid
  modified_base (9)..(9): base is a locked nucleic acid
accyccatyctttggat

SEQ ID NO: 9676 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (6)..(6): base is a locked nucleic acid
  modified_base (8)..(8): base is a locked nucleic acid
  modified_base (9)..(9): base is a locked nucleic acid
aaccyccatyctttgga

SEQ ID NO: 9677 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (3)..(3): base is a locked nucleic acid
  modified_base (8)..(8): base is a locked nucleic acid
  modified_base (9)..(9): base is a locked nucleic acid
accyccatyctttggat

SEQ ID NO: 9678 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (3)..(3): base is a locked nucleic acid
  modified_base (8)..(8): base is a locked nucleic acid
  modified_base (9)..(9): base is a locked nucleic acid
aaccyccatyctttgga

SEQ ID NO: 9679 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (1)..(1): base is a locked nucleic acid
  modified_base (8)..(8): base is a locked nucleic acid
  modified_base (9)..(9): base is a locked nucleic acid
accyccatyctttggat

SEQ ID NO: 9680 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (2)..(2): base is a locked nucleic acid
  modified_base (8)..(8): base is a locked nucleic acid
  modified_base (9)..(9): base is a locked nucleic acid
aaccyccatyctttgga

SEQ ID NO: 9681 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (7)..(7): base is a locked nucleic acid
  modified_base (8)..(8): base is a locked nucleic acid
  modified_base (9)..(9): base is a locked nucleic acid
accyccatyctttggat

SEQ ID NO: 9682 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
aaccyccatyctttgga

SEQ ID NO: 9683 - DNA, 17 bp, Artificial Sequence
  Oligonucleotide probe
  misc_binding (1)..(17): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
accyccatyctttggat

SEQ ID NO: 9684 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (10)..(10): base is a locked nucleic acid
aaccyccatyctttg

SEQ ID NO: 9685 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (10)..(10): base is a locked nucleic acid
accyccatyctttgg

SEQ ID NO: 9686 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (12)..(12): base is a locked nucleic acid
aaccyccatyctttg

SEQ ID NO: 9687 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (13)..(13): base is a locked nucleic acid
accyccatyctttgg

SEQ ID NO: 9688 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (15)..(15): base is a locked nucleic acid
aaccyccatyctttg

SEQ ID NO: 9689 - DNA, 15 bp, Artificial Sequence
  Oligonucleotide probe
  misc_binding (1)..(15): Hybridization probe for the specific detection of mutant HIV-1 at codon 227 of the reverse transcriptase gene.
accyccatyctttgg

SEQ ID NO: 9690 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (13)..(13): base is a locked nucleic acid
aaccyccatyctttg

SEQ ID NO: 9691 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (14)..(14): base is a locked nucleic acid
accyccatyctttgg

SEQ ID NO: 9692 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (3)..(3): base is a locked nucleic acid
aaccyccatyctttg

SEQ ID NO: 9693 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (4)..(4): base is a locked nucleic acid
accyccatyctttgg

SEQ ID NO: 9694 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (2)..(2): base is a locked nucleic acid
aaccyccatyctttg

SEQ ID NO: 9695 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (6)..(6): base is a locked nucleic acid
accyccatyctttgg

SEQ ID NO: 9696 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (6)..(6): base is a locked nucleic acid
aaccyccatyctttg

SEQ ID NO: 9697 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (1)..(1): base is a locked nucleic acid
accyccatyctttgg

SEQ ID NO: 9698 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (7)..(7): base is a locked nucleic acid
aaccyccatyctttg

SEQ ID NO: 9699 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
accyccatyctttgg

SEQ ID NO: 9700 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (10)..(10): base is a locked nucleic acid
aaccyccatyctttg

SEQ ID NO: 9701 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (15)..(15): base is a locked nucleic acid
accyccatyctttgg

SEQ ID NO: 9702 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (13)..(13): base is a locked nucleic acid
aaccyccatyctttg

SEQ ID NO: 9703 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
accyccatyctttgg

SEQ ID NO: 9704 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (12)..(12): base is a locked nucleic acid
aaccyccatyctttg

SEQ ID NO: 9705 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (12)..(12): base is a locked nucleic acid
accyccatyctttgg

SEQ ID NO: 9706 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (14)..(14): base is a locked nucleic acid
aaccyccatyctttg

SEQ ID NO: 9707 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (11)..(11): base is a locked nucleic acid
accyccatyctttgg

SEQ ID NO: 9708 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (7)..(7): base is a locked nucleic acid
  modified_base (8)..(8): base is a locked nucleic acid
  modified_base (9)..(9): base is a locked nucleic acid
aaccyccatyctttg

SEQ ID NO: 9709 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (4)..(4): base is a locked nucleic acid
  modified_base (8)..(8): base is a locked nucleic acid
  modified_base (9)..(9): base is a locked nucleic acid
accyccatyctttgg

SEQ ID NO: 9710 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (6)..(6): base is a locked nucleic acid
  modified_base (8)..(8): base is a locked nucleic acid
  modified_base (9)..(9): base is a locked nucleic acid
aaccyccatyctttg

SEQ ID NO: 9711 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (3)..(3): base is a locked nucleic acid
  modified_base (8)..(8): base is a locked nucleic acid
  modified_base (9)..(9): base is a locked nucleic acid
accyccatyctttgg

SEQ ID NO: 9712 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (3)..(3): base is a locked nucleic acid
  modified_base (8)..(8): base is a locked nucleic acid
  modified_base (9)..(9): base is a locked nucleic acid
aaccyccatyctttg

SEQ ID NO: 9713 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (1)..(1): base is a locked nucleic acid
  modified_base (8)..(8): base is a locked nucleic acid
  modified_base (9)..(9): base is a locked nucleic acid
accyccatyctttgg

SEQ ID NO: 9714 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (2)..(2): base is a locked nucleic acid
  modified_base (8)..(8): base is a locked nucleic acid
  modified_base (9)..(9): base is a locked nucleic acid
aaccyccatyctttg

SEQ ID NO: 9715 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (7)..(7): base is a locked nucleic acid
  modified_base (8)..(8): base is a locked nucleic acid
  modified_base (9)..(9): base is a locked nucleic acid
accyccatyctttgg

SEQ ID NO: 9716 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
aaccyccatyctttg

SEQ ID NO: 9717 - DNA, 15 bp, Artificial Sequence
  Oligonucleotide probe
  misc_binding (1)..(15): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
accyccatyctttgg

SEQ ID NO: 9718 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (10)..(10): base is a locked nucleic acid
aaccyccatyctt

SEQ ID NO: 9719 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (10)..(10): base is a locked nucleic acid
accyccatycttt

SEQ ID NO: 9720 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (12)..(12): base is a locked nucleic acid
aaccyccatyctt

SEQ ID NO: 9721 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (13)..(13): base is a locked nucleic acid
accyccatycttt

SEQ ID NO: 9722 - DNA, 14 bp, Artificial Sequence
  Oligonucleotide probe
  misc_binding (1)..(14): Hybridization probe for the specific detection of mutant HIV-1 at codon 227 of the reverse transcriptase gene.
aaccyccatycttt

SEQ ID NO: 9723 - DNA, 14 bp, Artificial Sequence
  Oligonucleotide probe
  misc_binding (1)..(14): Hybridization probe for the specific detection of mutant HIV-1 at codon 227 of the reverse transcriptase gene.
accyccatyctttg

SEQ ID NO: 9724 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (13)..(13): base is a locked nucleic acid
aaccyccatyctt

SEQ ID NO: 9725 - DNA, 13 bp, Artificial Sequence
  Oligonucleotide probe
  misc_binding (1)..(13): Hybridization probe for the specific detection of mutant HIV-1 at codon 227 of the reverse transcriptase gene.
accyccatycttt

SEQ ID NO: 9726 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (3)..(3): base is a locked nucleic acid
aaccyccatyctt

SEQ ID NO: 9727 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (4)..(4): base is a locked nucleic acid
accyccatycttt

SEQ ID NO: 9728 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (2)..(2): base is a locked nucleic acid
aaccyccatyctt

SEQ ID NO: 9729 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (6)..(6): base is a locked nucleic acid
accyccatycttt

SEQ ID NO: 9730 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (6)..(6): base is a locked nucleic acid
aaccyccatyctt

SEQ ID NO: 9731 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (1)..(1): base is a locked nucleic acid
accyccatycttt

SEQ ID NO: 9732 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (7)..(7): base is a locked nucleic acid
aaccyccatyctt

SEQ ID NO: 9733 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
accyccatycttt

SEQ ID NO: 9734 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (10)..(10): base is a locked nucleic acid
aaccyccatyctt

SEQ ID NO: 9735 - DNA, 14 bp, Artificial Sequence
  Oligonucleotide probe
  misc_binding (1)..(14): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
accyccatyctttg

SEQ ID NO: 9736 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (13)..(13): base is a locked nucleic acid
aaccyccatyctt

SEQ ID NO: 9737 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (12)..(12): base is a locked nucleic acid
aaccyccatyctt

SEQ ID NO: 9738 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (12)..(12): base is a locked nucleic acid
accyccatycttt

SEQ ID NO: 9739 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
aaccyccatyctt

SEQ ID NO: 9740 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
  modified_base (11)..(11): base is a locked nucleic acid
accyccatycttt

SEQ ID NO: 9741 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (7)..(7): base is a locked nucleic acid
  modified_base (8)..(8): base is a locked nucleic acid
  modified_base (9)..(9): base is a locked nucleic acid
aaccyccatyctt

SEQ ID NO: 9742 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (4)..(4): base is a locked nucleic acid
  modified_base (8)..(8): base is a locked nucleic acid
  modified_base (9)..(9): base is a locked nucleic acid
accyccatycttt

SEQ ID NO: 9743 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (6)..(6): base is a locked nucleic acid
  modified_base (8)..(8): base is a locked nucleic acid
  modified_base (9)..(9): base is a locked nucleic acid
aaccyccatyctt

SEQ ID NO: 9744 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (3)..(3): base is a locked nucleic acid
  modified_base (8)..(8): base is a locked nucleic acid
  modified_base (9)..(9): base is a locked nucleic acid
accyccatycttt

SEQ ID NO: 9745 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (3)..(3): base is a locked nucleic acid
  modified_base (8)..(8): base is a locked nucleic acid
  modified_base (9)..(9): base is a locked nucleic acid
aaccyccatyctt

SEQ ID NO: 9746 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (1)..(1): base is a locked nucleic acid
  modified_base (8)..(8): base is a locked nucleic acid
  modified_base (9)..(9): base is a locked nucleic acid
accyccatycttt

SEQ ID NO: 9747 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (2)..(2): base is a locked nucleic acid
  modified_base (8)..(8): base is a locked nucleic acid
  modified_base (9)..(9): base is a locked nucleic acid
aaccyccatyctt

SEQ ID NO: 9748 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (7)..(7): base is a locked nucleic acid
  modified_base (8)..(8): base is a locked nucleic acid
  modified_base (9)..(9): base is a locked nucleic acid
accyccatycttt

SEQ ID NO: 9749 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
aaccyccatyctt

SEQ ID NO: 9750 - DNA, 13 bp, Artificial Sequence
  Oligonucleotide probe
  misc_binding (1)..(13): Hybridization probe for the specific detection of mutant HIV-1 at codon 227 of the reverse transcriptase gene.
  modified_base (8)..(8): base is a locked nucleic acid
  modified_base (9)..(9): base is a locked nucleic acid
accyccatycttt

SEQ ID NO: 9751 - DNA, 15 bp, Artificial Sequence
  Oligonucleotide probe
  misc_binding (1)..(15): Hybridization probe for the specific detection of mutant HIV-1 at codon 227 of the reverse transcriptase gene.
cctccactyctttgg

SEQ ID NO: 9752 - DNA, 15 bp, Artificial Sequence
  Oligonucleotide probe
  misc_binding (1)..(15): Hybridization probe for the specific detection of mutant HIV-1 at codon 227 of the reverse transcriptase gene.
cctccattrctttgg

SEQ ID NO: 9753 - DNA, 15 bp, Artificial Sequence
  Oligonucleotide probe
  misc_binding (1)..(15): Hybridization probe for the specific detection of mutant HIV-1 at codon 227 of the reverse transcriptase gene.
cctccatgyctttgg

SEQ ID NO: 9754 - DNA, 18 bp, Artificial Sequence
  Oligonucleotide probe
  misc_binding (1)..(18): Hybridization probe for the specific detection of mutant HIV-1 at codon 227 of the reverse transcriptase gene.
gaaccyccatyctttgga

SEQ ID NO: 9755 - DNA, 18 bp, Artificial Sequence
  Oligonucleotide probe
  misc_binding (1)..(18): Hybridization probe for the specific detection of mutant HIV-1 at codon 227 of the reverse transcriptase gene.
aaccyccatyctttggat

SEQ ID NO: 9756 - DNA, 17 bp, Artificial Sequence
  Oligonucleotide probe
  misc_binding (1)..(17): Hybridization probe for the specific detection of mutant HIV-1 at codon 227 of the reverse transcriptase gene.
aaccyccatyctttgga

SEQ ID NO: 9757 - DNA, 17 bp, Artificial Sequence
  Oligonucleotide probe
  misc_binding (1)..(17): Hybridization probe for the specific detection of mutant HIV-1 at codon 227 of the reverse transcriptase gene.
accyccatyctttggat

SEQ ID NO: 9758 - DNA, 15 bp, Artificial Sequence
  Oligonucleotide probe
  misc_binding (1)..(15): Hybridization probe for the specific detection of mutant HIV-1 at codon 227 of the reverse transcriptase gene.
aaccyccatyctttg

SEQ ID NO: 9759 - DNA, 15 bp, Artificial Sequence
  Oligonucleotide probe
  misc_binding (1)..(15): Hybridization probe for the specific detection of mutant HIV-1 at codon 227 of the reverse transcriptase gene.
accyccatyctttgg

SEQ ID NO: 9760 - DNA, 13 bp, Artificial Sequence
  Oligonucleotide probe
  misc_binding (1)..(13): Hybridization probe for the specific detection of mutant HIV-1 at codon 227 of the reverse transcriptase gene.
aaccyccatyctt

SEQ ID NO: 9761 - DNA, 13 bp, Artificial Sequence
  Oligonucleotide probe
  misc_binding (1)..(13): Hybridization probe for the specific detection of mutant HIV-1 at codon 227 of the reverse transcriptase gene.
accyccatycttt

SEQ ID NO: 9762 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (14)..(14): base is a locked nucleic acid
ttyctttggtgggdtatg

SEQ ID NO: 9763 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (12)..(12): base is a locked nucleic acid
ttyctttggtgggdtatg

SEQ ID NO: 9764 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (16)..(16): base is a locked nucleic acid
ttyctttggtgggdtatg

SEQ ID NO: 9765 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (18)..(18): base is a locked nucleic acid
ttyctttggtgggdtatg

SEQ ID NO: 9766 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (9)..(9): base is a locked nucleic acid
ttyctttggtgggdtatg

SEQ ID NO: 9767 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (7)..(7): base is a locked nucleic acid
ttyctttggtgggdtatg

SEQ ID NO: 9768 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (3)..(3): base is a locked nucleic acid
ttyctttggtgggdtatg

SEQ ID NO: 9769 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (6)..(6): base is a locked nucleic acid
ttyctttggtgggdtatg

SEQ ID NO: 9770 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (9)..(9): base is a locked nucleic acid
  modified_base (10)..(10): base is a locked nucleic acid
  modified_base (18)..(18): base is a locked nucleic acid
ttyctttggtgggdtatg

SEQ ID NO: 9771 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (9)..(9): base is a locked nucleic acid
  modified_base (10)..(10): base is a locked nucleic acid
  modified_base (15)..(15): base is a locked nucleic acid
ttyctttggtgggdtatg

SEQ ID NO: 9772 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (9)..(9): base is a locked nucleic acid
  modified_base (10)..(10): base is a locked nucleic acid
  modified_base (13)..(13): base is a locked nucleic acid
ttyctttggtgggdtatg

SEQ ID NO: 9773 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (9)..(9): base is a locked nucleic acid
  modified_base (10)..(10): base is a locked nucleic acid
  modified_base (11)..(11): base is a locked nucleic acid
ttyctttggtgggdtatg

SEQ ID NO: 9774 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (4)..(4): base is a locked nucleic acid
  modified_base (9)..(9): base is a locked nucleic acid
  modified_base (10)..(10): base is a locked nucleic acid
ttyctttggtgggdtatg

SEQ ID NO: 9775 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (2)..(2): base is a locked nucleic acid
  modified_base (9)..(9): base is a locked nucleic acid
  modified_base (10)..(10): base is a locked nucleic acid
ttyctttggtgggdtatg

SEQ ID NO: 9776 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (3)..(3): base is a locked nucleic acid
  modified_base (9)..(9): base is a locked nucleic acid
  modified_base (10)..(10): base is a locked nucleic acid
ttyctttggtgggdtatg

SEQ ID NO: 9777 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (10)..(10): base is a locked nucleic acid
ttyctttggtgggdtatg

SEQ ID NO: 9778 - DNA, 18 bp, Artificial Sequence
  Oligonucleotide probe
  misc_binding (1)..(18): Hybridization probe for the specific detection of mutant HIV-1 at codon 230 of the reverse transcriptase gene.
  modified_base (9)..(9): base is a locked nucleic acid
  modified_base (10)..(10): base is a locked nucleic acid
ttyctttggtgggdtatg

SEQ ID NO: 9779 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (13)..(13): base is a locked nucleic acid
tyctttggtgggdtatg

SEQ ID NO: 9780 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (11)..(11): base is a locked nucleic acid
tyctttggtgggdtatg

SEQ ID NO: 9781 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (15)..(15): base is a locked nucleic acid
tyctttggtgggdtatg

SEQ ID NO: 9782 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (17)..(17): base is a locked nucleic acid
tyctttggtgggdtatg

SEQ ID NO: 9783 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (8)..(8): base is a locked nucleic acid
tyctttggtgggdtatg

SEQ ID NO: 9784 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (6)..(6): base is a locked nucleic acid
tyctttggtgggdtatg

SEQ ID NO: 9785 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (2)..(2): base is a locked nucleic acid
tyctttggtgggdtatg

SEQ ID NO: 9786 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (5)..(5): base is a locked nucleic acid
tyctttggtgggdtatg

SEQ ID NO: 9787 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (17)..(17): base is a locked nucleic acid
tyctttggtgggdtatg

SEQ ID NO: 9788 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (14)..(14): base is a locked nucleic acid
tyctttggtgggdtatg

SEQ ID NO: 9789 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (12)..(12): base is a locked nucleic acid
tyctttggtgggdtatg

SEQ ID NO: 9790 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (10)..(10): base is a locked nucleic acid
tyctttggtgggdtatg

SEQ ID NO: 9791 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (3)..(3): base is a locked nucleic acid
  modified_base (8)..(8): base is a locked nucleic acid
  modified_base (9)..(9): base is a locked nucleic acid
tyctttggtgggdtatg

SEQ ID NO: 9792 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (1)..(1): base is a locked nucleic acid
  modified_base (8)..(8): base is a locked nucleic acid
  modified_base (9)..(9): base is a locked nucleic acid
tyctttggtgggdtatg

SEQ ID NO: 9793 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (2)..(2): base is a locked nucleic acid
  modified_base (8)..(8): base is a locked nucleic acid
  modified_base (9)..(9): base is a locked nucleic acid
tyctttggtgggdtatg

SEQ ID NO: 9794 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (7)..(7): base is a locked nucleic acid
  modified_base (8)..(8): base is a locked nucleic acid
  modified_base (9)..(9): base is a locked nucleic acid
tyctttggtgggdtatg

SEQ ID NO: 9795 - DNA, 17 bp, Artificial Sequence
  Oligonucleotide probe
  misc_binding (1)..(17): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
tyctttggtgggdtatg

SEQ ID NO: 9796 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (13)..(13): base is a locked nucleic acid
tyctttggtgggdta

SEQ ID NO: 9797 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (11)..(11): base is a locked nucleic acid
tyctttggtgggdta

SEQ ID NO: 9798 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (15)..(15): base is a locked nucleic acid
tyctttggtgggdta

SEQ ID NO: 9799 - DNA, 16 bp, Artificial Sequence
  Oligonucleotide probe
  misc_binding (1)..(16): Hybridization probe for the specific detection of mutant HIV-1 at codon 230 of the reverse transcriptase gene.
tyctttggtgggdtat

SEQ ID NO: 9800 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (8)..(8): base is a locked nucleic acid
tyctttggtgggdta

SEQ ID NO: 9801 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (6)..(6): base is a locked nucleic acid
tyctttggtgggdta

SEQ ID NO: 9802 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (2)..(2): base is a locked nucleic acid
tyctttggtgggdta

SEQ ID NO: 9803 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (5)..(5): base is a locked nucleic acid
tyctttggtgggdta

SEQ ID NO: 9804 - DNA, 16 bp, Artificial Sequence
  Oligonucleotide probe
  misc_binding (1)..(16): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
tyctttggtgggdtat

SEQ ID NO: 9805 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (14)..(14): base is a locked nucleic acid
tyctttggtgggdta

SEQ ID NO: 9806 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (12)..(12): base is a locked nucleic acid
tyctttggtgggdta

SEQ ID NO: 9807 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (10)..(10): base is a locked nucleic acid
tyctttggtgggdta

SEQ ID NO: 9808 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (3)..(3): base is a locked nucleic acid
  modified_base (8)..(8): base is a locked nucleic acid
  modified_base (9)..(9): base is a locked nucleic acid
tyctttggtgggdta

SEQ ID NO: 9809 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (1)..(1): base is a locked nucleic acid
  modified_base (8)..(8): base is a locked nucleic acid
  modified_base (9)..(9): base is a locked nucleic acid
tyctttggtgggdta

SEQ ID NO: 9810 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (2)..(2): base is a locked nucleic acid
  modified_base (8)..(8): base is a locked nucleic acid
  modified_base (9)..(9): base is a locked nucleic acid
tyctttggtgggdta

SEQ ID NO: 9811 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (7)..(7): base is a locked nucleic acid
  modified_base (8)..(8): base is a locked nucleic acid
  modified_base (9)..(9): base is a locked nucleic acid
tyctttggtgggdta

SEQ ID NO: 9812 - DNA, 15 bp, Artificial Sequence
  Oligonucleotide probe
  misc_binding (1)..(15): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
tyctttggtgggdta

SEQ ID NO: 9813 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (13)..(13): base is a locked nucleic acid
tyctttggtgggd

SEQ ID NO: 9814 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (11)..(11): base is a locked nucleic acid
tyctttggtgggd

SEQ ID NO: 9815 - DNA, 14 bp, Artificial Sequence
  Oligonucleotide probe
  misc_binding (1)..(14): Hybridization probe for the specific detection of mutant HIV-1 at codon 230 of the reverse transcriptase gene.
tyctttggtgggdt

SEQ ID NO: 9816 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (8)..(8): base is a locked nucleic acid
tyctttggtgggd

SEQ ID NO: 9817 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (6)..(6): base is a locked nucleic acid
tyctttggtgggd

SEQ ID NO: 9818 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (2)..(2): base is a locked nucleic acid
tyctttggtgggd

SEQ ID NO: 9819 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (5)..(5): base is a locked nucleic acid
tyctttggtgggd

SEQ ID NO: 9820 - DNA, 14 bp, Artificial Sequence
  Oligonucleotide probe
  misc_binding (1)..(14): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
tyctttggtgggdt

SEQ ID NO: 9821 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
tyctttggtgggd

SEQ ID NO: 9822 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (12)..(12): base is a locked nucleic acid
tyctttggtgggd

SEQ ID NO: 9823 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
  modified_base (10)..(10): base is a locked nucleic acid
tyctttggtgggd

SEQ ID NO: 9824 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (3)..(3): base is a locked nucleic acid
  modified_base (8)..(8): base is a locked nucleic acid
  modified_base (9)..(9): base is a locked nucleic acid
tyctttggtgggd

SEQ ID NO: 9825 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (1)..(1): base is a locked nucleic acid
  modified_base (8)..(8): base is a locked nucleic acid
  modified_base (9)..(9): base is a locked nucleic acid
tyctttggtgggd

SEQ ID NO: 9826 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (2)..(2): base is a locked nucleic acid
  modified_base (8)..(8): base is a locked nucleic acid
  modified_base (9)..(9): base is a locked nucleic acid
tyctttggtgggd

SEQ ID NO: 9827 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (7)..(7): base is a locked nucleic acid
  modified_base (8)..(8): base is a locked nucleic acid
  modified_base (9)..(9): base is a locked nucleic acid
tyctttggtgggd

SEQ ID NO: 9828 - DNA, 13 bp, Artificial Sequence
  Oligonucleotide probe
  misc_binding (1)..(13): Hybridization probe for the specific detection of mutant HIV-1 at codon 230 of the reverse transcriptase gene.
  modified_base (8)..(8): base is a locked nucleic acid
  modified_base (9)..(9): base is a locked nucleic acid
tyctttggtgggd

SEQ ID NO: 9829 - DNA, 15 bp, Artificial Sequence
  Oligonucleotide probe
  misc_binding (1)..(15): Hybridization probe for the specific detection of mutant HIV-1 at codon 230 of the reverse transcriptase gene.
cctttggytgggtta

SEQ ID NO: 9830 - DNA, 18 bp, Artificial Sequence
  Oligonucleotide probe
  misc_binding (1)..(18): Hybridization probe for the specific detection of mutant HIV-1 at codon 230 of the reverse transcriptase gene.
ttyctttggtgggdtatg

SEQ ID NO: 9831 - DNA, 17 bp, Artificial Sequence
  Oligonucleotide probe
  misc_binding (1)..(17): Hybridization probe for the specific detection of mutant HIV-1 at codon 230 of the reverse transcriptase gene.
tyctttggtgggdtatg

SEQ ID NO: 9832 - DNA, 15 bp, Artificial Sequence
  Oligonucleotide probe
  misc_binding (1)..(15): Hybridization probe for the specific detection of mutant HIV-1 at codon 230 of the reverse transcriptase gene.
tyctttggtgggdta

SEQ ID NO: 9833 - DNA, 13 bp, Artificial Sequence
  Oligonucleotide probe
  misc_binding (1)..(13): Hybridization probe for the specific detection of mutant HIV-1 at codon 230 of the reverse transcriptase gene.
tyctttggtgggd

SEQ ID NO: 9834 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (11)..(11): base is a locked nucleic acid
atcctgayartggacagt

SEQ ID NO: 9835 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (15)..(15): base is a locked nucleic acid
atcctgayartggacagt

SEQ ID NO: 9836 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (18)..(18): base is a locked nucleic acid
atcctgayartggacagt

SEQ ID NO: 9837 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (12)..(12): base is a locked nucleic acid
atcctgayartggacagt

SEQ ID NO: 9838 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (7)..(7): base is a locked nucleic acid
atcctgayartggacagt

SEQ ID NO: 9839 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (8)..(8): base is a locked nucleic acid
atcctgayartggacagt

SEQ ID NO: 9840 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (4)..(4): base is a locked nucleic acid
atcctgayartggacagt

SEQ ID NO: 9841 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (2)..(2): base is a locked nucleic acid
atcctgayartggacagt

SEQ ID NO: 9842 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (17)..(17): base is a locked nucleic acid
atcctgayartggacagt

SEQ ID NO: 9843 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (13)..(13): base is a locked nucleic acid
atcctgayartggacagt

SEQ ID NO: 9844 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (15)..(15): base is a locked nucleic acid
atcctgayartggacagt

SEQ ID NO: 9845 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (16)..(16): base is a locked nucleic acid
atcctgayartggacagt

SEQ ID NO: 9846 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (3)..(3): base is a locked nucleic acid
  modified_base (9)..(9): base is a locked nucleic acid
  modified_base (10)..(10): base is a locked nucleic acid
atcctgayartggacagt

SEQ ID NO: 9847 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (6)..(6): base is a locked nucleic acid
  modified_base (9)..(9): base is a locked nucleic acid
  modified_base (10)..(10): base is a locked nucleic acid
atcctgayartggacagt

SEQ ID NO: 9848 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (8)..(8): base is a locked nucleic acid
  modified_base (9)..(9): base is a locked nucleic acid
  modified_base (10)..(10): base is a locked nucleic acid
atcctgayartggacagt

SEQ ID NO: 9849 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (4)..(4): base is a locked nucleic acid
  modified_base (9)..(9): base is a locked nucleic acid
  modified_base (10)..(10): base is a locked nucleic acid
atcctgayartggacagt

SEQ ID NO: 9850 - DNA, 18 bp, Artificial Sequence
  Oligonucleotide probe
  misc_binding (1)..(18): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
atcctgayartggacagt

SEQ ID NO: 9851 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (11)..(11): base is a locked nucleic acid
atcctgayartggacag

SEQ ID NO: 9852 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (15)..(15): base is a locked nucleic acid
atcctgayartggacag

SEQ ID NO: 9853 - DNA, 17 bp, Artificial Sequence
  Oligonucleotide probe
  misc_binding (1)..(17): Hybridization probe for the specific detection of mutant HIV-1 at codon 238 of the reverse transcriptase gene.
atcctgayartggacag

SEQ ID NO: 9854 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (12)..(12): base is a locked nucleic acid
atcctgayartggacag

SEQ ID NO: 9855 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (7)..(7): base is a locked nucleic acid
atcctgayartggacag

SEQ ID NO: 9856 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (8)..(8): base is a locked nucleic acid
atcctgayartggacag

SEQ ID NO: 9857 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (4)..(4): base is a locked nucleic acid
atcctgayartggacag

SEQ ID NO: 9858 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (2)..(2): base is a locked nucleic acid
atcctgayartggacag

SEQ ID NO: 9859 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (17)..(17): base is a locked nucleic acid
atcctgayartggacag

SEQ ID NO: 9860 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (13)..(13): base is a locked nucleic acid
atcctgayartggacag

SEQ ID NO: 9861 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (15)..(15): base is a locked nucleic acid
atcctgayartggacag

SEQ ID NO: 9862 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (16)..(16): base is a locked nucleic acid
atcctgayartggacag

SEQ ID NO: 9863 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (3)..(3): base is a locked nucleic acid
  modified_base (9)..(9): base is a locked nucleic acid
  modified_base (10)..(10): base is a locked nucleic acid
atcctgayartggacag

SEQ ID NO: 9864 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (6)..(6): base is a locked nucleic acid
  modified_base (9)..(9): base is a locked nucleic acid
  modified_base (10)..(10): base is a locked nucleic acid
atcctgayartggacag

SEQ ID NO: 9865 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (8)..(8): base is a locked nucleic acid
  modified_base (9)..(9): base is a locked nucleic acid
  modified_base (10)..(10): base is a locked nucleic acid
atcctgayartggacag

SEQ ID NO: 9866 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (4)..(4): base is a locked nucleic acid
  modified_base (9)..(9): base is a locked nucleic acid
  modified_base (10)..(10): base is a locked nucleic acid
atcctgayartggacag

SEQ ID NO: 9867 - DNA, 17 bp, Artificial Sequence
  Oligonucleotide probe
  misc_binding (1)..(17): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
atcctgayartggacag

SEQ ID NO: 9868 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (11)..(11): base is a locked nucleic acid
atcctgayartggac

SEQ ID NO: 9869 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (15)..(15): base is a locked nucleic acid
atcctgayartggac

SEQ ID NO: 9870 - DNA, 16 bp, Artificial Sequence
  Oligonucleotide probe
  misc_binding (1)..(16): Hybridization probe for the specific detection of mutant HIV-1 at codon 238 of the reverse transcriptase gene.
atcctgayartggaca

SEQ ID NO: 9871 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (12)..(12): base is a locked nucleic acid
atcctgayartggac

SEQ ID NO: 9872 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (7)..(7): base is a locked nucleic acid
atcctgayartggac

SEQ ID NO: 9873 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (8)..(8): base is a locked nucleic acid
atcctgayartggac

SEQ ID NO: 9874 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (4)..(4): base is a locked nucleic acid
atcctgayartggac

SEQ ID NO: 9875 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (2)..(2): base is a locked nucleic acid
atcctgayartggac

SEQ ID NO: 9876 - DNA, 16 bp, Artificial Sequence
  Oligonucleotide probe
  misc_binding (1)..(16): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
atcctgayartggaca

SEQ ID NO: 9877 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (13)..(13): base is a locked nucleic acid
atcctgayartggac

SEQ ID NO: 9878 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (15)..(15): base is a locked nucleic acid
atcctgayartggac

SEQ ID NO: 9879 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
atcctgayartggac

SEQ ID NO: 9880 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (3)..(3): base is a locked nucleic acid
  modified_base (9)..(9): base is a locked nucleic acid
  modified_base (10)..(10): base is a locked nucleic acid
atcctgayartggac

SEQ ID NO: 9881 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (6)..(6): base is a locked nucleic acid
  modified_base (9)..(9): base is a locked nucleic acid
  modified_base (10)..(10): base is a locked nucleic acid
atcctgayartggac

SEQ ID NO: 9882 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (8)..(8): base is a locked nucleic acid
  modified_base (9)..(9): base is a locked nucleic acid
  modified_base (10)..(10): base is a locked nucleic acid
atcctgayartggac

SEQ ID NO: 9883 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (4)..(4): base is a locked nucleic acid
  modified_base (9)..(9): base is a locked nucleic acid
  modified_base (10)..(10): base is a locked nucleic acid
atcctgayartggac

SEQ ID NO: 9884 - DNA, 15 bp, Artificial Sequence
  Oligonucleotide probe
  misc_binding (1)..(15): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
atcctgayartggac

SEQ ID NO: 9885 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (11)..(11): base is a locked nucleic acid
atcctgayartgg

SEQ ID NO: 9886 - DNA, 14 bp, Artificial Sequence
  Oligonucleotide probe
  misc_binding (1)..(14): Hybridization probe for the specific detection of mutant HIV-1 at codon 238 of the reverse transcriptase gene.
atcctgayartgga

SEQ ID NO: 9887 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (12)..(12): base is a locked nucleic acid
atcctgayartgg

SEQ ID NO: 9888 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (7)..(7): base is a locked nucleic acid
atcctgayartgg

SEQ ID NO: 9889 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (8)..(8): base is a locked nucleic acid
atcctgayartgg

SEQ ID NO: 9890 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (4)..(4): base is a locked nucleic acid
atcctgayartgg

SEQ ID NO: 9891 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (2)..(2): base is a locked nucleic acid
atcctgayartgg

SEQ ID NO: 9892 - DNA, 14 bp, Artificial Sequence
  Oligonucleotide probe
  misc_binding (1)..(14): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
atcctgayartgga

SEQ ID NO: 9893 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
  modified_base (13)..(13): base is a locked nucleic acid
atcctgayartgg

SEQ ID NO: 9894 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (3)..(3): base is a locked nucleic acid
  modified_base (9)..(9): base is a locked nucleic acid
  modified_base (10)..(10): base is a locked nucleic acid
atcctgayartgg

SEQ ID NO: 9895 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (6)..(6): base is a locked nucleic acid
  modified_base (9)..(9): base is a locked nucleic acid
  modified_base (10)..(10): base is a locked nucleic acid
atcctgayartgg

SEQ ID NO: 9896 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (8)..(8): base is a locked nucleic acid
  modified_base (9)..(9): base is a locked nucleic acid
  modified_base (10)..(10): base is a locked nucleic acid
atcctgayartgg

SEQ ID NO: 9897 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (4)..(4): base is a locked nucleic acid
  modified_base (9)..(9): base is a locked nucleic acid
  modified_base (10)..(10): base is a locked nucleic acid
atcctgayartgg

SEQ ID NO: 9898 - DNA, 13 bp, Artificial Sequence
  Oligonucleotide probe
  misc_binding (1)..(13): Hybridization probe for the specific detection of mutant HIV-1 at codon 238 of the reverse transcriptase gene.
  modified_base (9)..(9): base is a locked nucleic acid
  modified_base (10)..(10): base is a locked nucleic acid
atcctgayartgg

SEQ ID NO: 9899 - DNA, 15 bp, Artificial Sequence
  Oligonucleotide probe
  misc_binding (1)..(15): Hybridization probe for the specific detection of mutant HIV-1 at codon 238 of the reverse transcriptase gene.
cctgatacrtggaca

SEQ ID NO: 9900 - DNA, 18 bp, Artificial Sequence
  Oligonucleotide probe
  misc_binding (1)..(18): Hybridization probe for the specific detection of mutant HIV-1 at codon 238 of the reverse transcriptase gene.
atcctgayartggacagt

SEQ ID NO: 9901 - DNA, 17 bp, Artificial Sequence
  Oligonucleotide probe
  misc_binding (1)..(17): Hybridization probe for the specific detection of mutant HIV-1 at codon 238 of the reverse transcriptase gene.
atcctgayartggacag

SEQ ID NO: 9902 - DNA, 15 bp, Artificial Sequence
  Oligonucleotide probe
  misc_binding (1)..(15): Hybridization probe for the specific detection of mutant HIV-1 at codon 238 of the reverse transcriptase gene.
atcctgayartggac

SEQ ID NO: 9903 - DNA, 13 bp, Artificial Sequence
  Oligonucleotide probe
  misc_binding (1)..(13): Hybridization probe for the specific detection of mutant HIV-1 at codon 238 of the reverse transcriptase gene.
atcctgayartgg

SEQ ID NO: 9904 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (11)..(11): base is a locked nucleic acid
tggrgyvtatatgaycca

SEQ ID NO: 9905 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (18)..(18): base is a locked nucleic acid
tggrgyvtatatgaycca

SEQ ID NO: 9906 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (13)..(13): base is a locked nucleic acid
tggrgyvtatatgaycca

SEQ ID NO: 9907 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (16)..(16): base is a locked nucleic acid
tggrgyvtatatgaycca

SEQ ID NO: 9908 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (4)..(4): base is a locked nucleic acid
tggrgyvtatatgaycca

SEQ ID NO: 9909 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (3)..(3): base is a locked nucleic acid
tggrgyvtatatgaycca

SEQ ID NO: 9910 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (5)..(5): base is a locked nucleic acid
tggrgyvtatatgaycca

SEQ ID NO: 9911 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (7)..(7): base is a locked nucleic acid
tggrgyvtatatgaycca

SEQ ID NO: 9912 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (9)..(9): base is a locked nucleic acid
  modified_base (10)..(10): base is a locked nucleic acid
  modified_base (14)..(14): base is a locked nucleic acid
tggrgyvtatatgaycca

SEQ ID NO: 9913 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (9)..(9): base is a locked nucleic acid
  modified_base (10)..(10): base is a locked nucleic acid
  modified_base (16)..(16): base is a locked nucleic acid
tggrgyvtatatgaycca

SEQ ID NO: 9914 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (9)..(9): base is a locked nucleic acid
  modified_base (10)..(10): base is a locked nucleic acid
  modified_base (13)..(13): base is a locked nucleic acid
tggrgyvtatatgaycca

SEQ ID NO: 9915 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (9)..(9): base is a locked nucleic acid
  modified_base (10)..(10): base is a locked nucleic acid
  modified_base (11)..(11): base is a locked nucleic acid
tggrgyvtatatgaycca

SEQ ID NO: 9916 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (10)..(10): base is a locked nucleic acid
tggrgyvtatatgaycca

SEQ ID NO: 9917 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (3)..(3): base is a locked nucleic acid
  modified_base (9)..(9): base is a locked nucleic acid
  modified_base (10)..(10): base is a locked nucleic acid
tggrgyvtatatgaycca

SEQ ID NO: 9918 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (7)..(7): base is a locked nucleic acid
  modified_base (9)..(9): base is a locked nucleic acid
  modified_base (10)..(10): base is a locked nucleic acid
tggrgyvtatatgaycca

SEQ ID NO: 9919 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (6)..(6): base is a locked nucleic acid
  modified_base (9)..(9): base is a locked nucleic acid
  modified_base (10)..(10): base is a locked nucleic acid
tggrgyvtatatgaycca

SEQ ID NO: 9920 - DNA, 18 bp, Artificial Sequence
  Oligonucleotide probe
  misc_binding (1)..(18): Hybridization probe for the specific detection of mutant HIV-1 at codon 318 of the reverse transcriptase gene.
  modified_base (9)..(9): base is a locked nucleic acid
  modified_base (10)..(10): base is a locked nucleic acid
tggrgyvtatatgaycca

SEQ ID NO: 9921 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (10)..(10): base is a locked nucleic acid
ggrgyvtatatgaycca

SEQ ID NO: 9922 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (17)..(17): base is a locked nucleic acid
ggrgyvtatatgaycca

SEQ ID NO: 9923 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (12)..(12): base is a locked nucleic acid
ggrgyvtatatgaycca

SEQ ID NO: 9924 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (15)..(15): base is a locked nucleic acid
ggrgyvtatatgaycca

SEQ ID NO: 9925 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (3)..(3): base is a locked nucleic acid
ggrgyvtatatgaycca

SEQ ID NO: 9926 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (2)..(2): base is a locked nucleic acid
ggrgyvtatatgaycca

SEQ ID NO: 9927 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (4)..(4): base is a locked nucleic acid
ggrgyvtatatgaycca

SEQ ID NO: 9928 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (6)..(6): base is a locked nucleic acid
ggrgyvtatatgaycca

SEQ ID NO: 9929 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (13)..(13): base is a locked nucleic acid
ggrgyvtatatgaycca

SEQ ID NO: 9930 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (15)..(15): base is a locked nucleic acid
ggrgyvtatatgaycca

SEQ ID NO: 9931 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (12)..(12): base is a locked nucleic acid
ggrgyvtatatgaycca

SEQ ID NO: 9932 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (10)..(10): base is a locked nucleic acid
ggrgyvtatatgaycca

SEQ ID NO: 9933 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (7)..(7): base is a locked nucleic acid
  modified_base (8)..(8): base is a locked nucleic acid
  modified_base (9)..(9): base is a locked nucleic acid
ggrgyvtatatgaycca

SEQ ID NO: 9934 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (2)..(2): base is a locked nucleic acid
  modified_base (8)..(8): base is a locked nucleic acid
  modified_base (9)..(9): base is a locked nucleic acid
ggrgyvtatatgaycca

SEQ ID NO: 9935 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (6)..(6): base is a locked nucleic acid
  modified_base (8)..(8): base is a locked nucleic acid
  modified_base (9)..(9): base is a locked nucleic acid
ggrgyvtatatgaycca

SEQ ID NO: 9936 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (5)..(5): base is a locked nucleic acid
  modified_base (8)..(8): base is a locked nucleic acid
  modified_base (9)..(9): base is a locked nucleic acid
ggrgyvtatatgaycca

SEQ ID NO: 9937 - DNA, 17 bp, Artificial Sequence
  Oligonucleotide probe
  misc_binding (1)..(17): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
ggrgyvtatatgaycca

SEQ ID NO: 9938 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (10)..(10): base is a locked nucleic acid
ggrgyvtatatgayc

SEQ ID NO: 9939 - DNA, 16 bp, Artificial Sequence
  Oligonucleotide probe
  misc_binding (1)..(16): Hybridization probe for the specific detection of mutant HIV-1 at codon 318 of the reverse transcriptase gene.
ggrgyvtatatgaycc

SEQ ID NO: 9940 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (12)..(12): base is a locked nucleic acid
ggrgyvtatatgayc

SEQ ID NO: 9941 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (15)..(15): base is a locked nucleic acid
ggrgyvtatatgayc

SEQ ID NO: 9942 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (3)..(3): base is a locked nucleic acid
ggrgyvtatatgayc

SEQ ID NO: 9943 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (2)..(2): base is a locked nucleic acid
ggrgyvtatatgayc

SEQ ID NO: 9944 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (4)..(4): base is a locked nucleic acid
ggrgyvtatatgayc

SEQ ID NO: 9945 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (6)..(6): base is a locked nucleic acid
ggrgyvtatatgayc

SEQ ID NO: 9946 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (13)..(13): base is a locked nucleic acid
ggrgyvtatatgayc

SEQ ID NO: 9947 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (15)..(15): base is a locked nucleic acid
ggrgyvtatatgayc

SEQ ID NO: 9948 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (12)..(12): base is a locked nucleic acid
ggrgyvtatatgayc

SEQ ID NO: 9949 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (10)..(10): base is a locked nucleic acid
ggrgyvtatatgayc

SEQ ID NO: 9950 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (7)..(7): base is a locked nucleic acid
  modified_base (8)..(8): base is a locked nucleic acid
  modified_base (9)..(9): base is a locked nucleic acid
ggrgyvtatatgayc

SEQ ID NO: 9951 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (2)..(2): base is a locked nucleic acid
  modified_base (8)..(8): base is a locked nucleic acid
  modified_base (9)..(9): base is a locked nucleic acid
ggrgyvtatatgayc

SEQ ID NO: 9952 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (6)..(6): base is a locked nucleic acid
  modified_base (8)..(8): base is a locked nucleic acid
  modified_base (9)..(9): base is a locked nucleic acid
ggrgyvtatatgayc

SEQ ID NO: 9953 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (5)..(5): base is a locked nucleic acid
  modified_base (8)..(8): base is a locked nucleic acid
  modified_base (9)..(9): base is a locked nucleic acid
ggrgyvtatatgayc

SEQ ID NO: 9954 - DNA, 15 bp, Artificial Sequence
  Oligonucleotide probe
  misc_binding (1)..(15): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
ggrgyvtatatgayc

SEQ ID NO: 9955 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (10)..(10): base is a locked nucleic acid
ggrgyvtatatga

SEQ ID NO: 9956 - DNA, 14 bp, Artificial Sequence
  Oligonucleotide probe
  misc_binding (1)..(14): Hybridization probe for the specific detection of mutant HIV-1 at codon 318 of the reverse transcriptase gene.
ggrgyvtatatgay

SEQ ID NO: 9957 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (12)..(12): base is a locked nucleic acid
ggrgyvtatatga

SEQ ID NO: 9958 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (3)..(3): base is a locked nucleic acid
ggrgyvtatatga

SEQ ID NO: 9959 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (2)..(2): base is a locked nucleic acid
ggrgyvtatatga

SEQ ID NO: 9960 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (4)..(4): base is a locked nucleic acid
ggrgyvtatatga

SEQ ID NO: 9961 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (6)..(6): base is a locked nucleic acid
ggrgyvtatatga

SEQ ID NO: 9962 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (13)..(13): base is a locked nucleic acid
ggrgyvtatatga

SEQ ID NO: 9963 - DNA, 14 bp, Artificial Sequence
  Oligonucleotide probe
  misc_binding (1)..(14): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
ggrgyvtatatgay

SEQ ID NO: 9964 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (12)..(12): base is a locked nucleic acid
ggrgyvtatatga

SEQ ID NO: 9965 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
  modified_base (10)..(10): base is a locked nucleic acid
ggrgyvtatatga

SEQ ID NO: 9966 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (7)..(7): base is a locked nucleic acid
  modified_base (8)..(8): base is a locked nucleic acid
  modified_base (9)..(9): base is a locked nucleic acid
ggrgyvtatatga

SEQ ID NO: 9967 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (2)..(2): base is a locked nucleic acid
  modified_base (8)..(8): base is a locked nucleic acid
  modified_base (9)..(9): base is a locked nucleic acid
ggrgyvtatatga

SEQ ID NO: 9968 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (6)..(6): base is a locked nucleic acid
  modified_base (8)..(8): base is a locked nucleic acid
  modified_base (9)..(9): base is a locked nucleic acid
ggrgyvtatatga

SEQ ID NO: 9969 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (5)..(5): base is a locked nucleic acid
  modified_base (8)..(8): base is a locked nucleic acid
  modified_base (9)..(9): base is a locked nucleic acid
ggrgyvtatatga

SEQ ID NO: 9970 - DNA, 13 bp, Artificial Sequence
  Oligonucleotide probe
  misc_binding (1)..(13): Hybridization probe for the specific detection of mutant HIV-1 at codon 318 of the reverse transcriptase gene.
  modified_base (8)..(8): base is a locked nucleic acid
  modified_base (9)..(9): base is a locked nucleic acid
ggrgyvtatatga

SEQ ID NO: 9971 - DNA, 15 bp, Artificial Sequence
  Oligonucleotide probe
  misc_binding (1)..(15): Hybridization probe for the specific detection of mutant HIV-1 at codon 318 of the reverse transcriptase gene.
tggagttyattatga

SEQ ID NO: 9972 - DNA, 18 bp, Artificial Sequence
  Oligonucleotide probe
  misc_binding (1)..(18): Hybridization probe for the specific detection of mutant HIV-1 at codon 318 of the reverse transcriptase gene.
tggrgyvtatatgaycca

SEQ ID NO: 9973 - DNA, 17 bp, Artificial Sequence
  Oligonucleotide probe
  misc_binding (1)..(17): Hybridization probe for the specific detection of mutant HIV-1 at codon 318 of the reverse transcriptase gene.
ggrgyvtatatgaycca

SEQ ID NO: 9974 - DNA, 15 bp, Artificial Sequence
  Oligonucleotide probe
  misc_binding (1)..(15): Hybridization probe for the specific detection of mutant HIV-1 at codon 318 of the reverse transcriptase gene.
ggrgyvtatatgayc

SEQ ID NO: 9975 - DNA, 13 bp, Artificial Sequence
  Oligonucleotide probe
  misc_binding (1)..(13): Hybridization probe for the specific detection of mutant HIV-1 at codon 318 of the reverse transcriptase gene.
ggrgyvtatatga

SEQ ID NO: 9976 - DNA, 45 bp, Artificial Sequence
  Pan degenerate oligonucleotide primer
  primer_bind (1)..(45)
  misc_feature (1)..(1): n is a, c, g, or t
  misc_feature (39)..(45): Adaptor region of the pan degenerate sense primer that adapts the probe-binding site upstream of codon 10 to correspond to the nucleotides in an oligonucleotide probe upstream of the discriminating single nucleotide polymorphism.
nhhrtatccytyrrcytccctcaratcactctttggcarcgaccc

SEQ ID NO: 9977 - DNA, 46 bp, Artificial Sequence
  Pan degenerate oligonucleotide primer
  primer_bind (1)..(46)
  misc_feature (1)..(1): n is a, c, g, or t
  misc_feature (39)..(45): Adaptor region of the pan degenerate sense primer that adapts the probe-binding site upstream of codon 10 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
nhhrtatccytyrrcytccctcaratcactctttggcarcgacccn

SEQ ID NO: 9978 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 11 to correspond to the nucleotides in an oligonucleotide probe upstream of the discriminating single nucleotide polymorphism.
rtatccytyrrcytccctcaratcactctttggcarcgacccctc

SEQ ID NO: 9979 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 11 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
rtatccytyrrcytccctcaratcactctttggcarcgacccctcn

SEQ ID NO: 9980 - DNA, 45 bp, Artificial Sequence
  Pan degenerate oligonucleotide primer
  primer_bind (1)..(45)
  misc_feature (16)..(16): n is a, c, g, or t
  misc_feature (39)..(45): Adaptor region of the pan degenerate sense primer that adapts the probe-binding site upstream of codon 20 to correspond to the nucleotides in an oligonucleotide probe upstream of the discriminating single nucleotide polymorphism.
ctttggcarcgaccmnthgtydcartaarrrtagrrggvcaacta

SEQ ID NO: 9981 - DNA, 46 bp, Artificial Sequence
  Pan degenerate oligonucleotide primer
  primer_bind (1)..(46)
  misc_feature (16)..(16): n is a, c, g, or t
  misc_feature (39)..(45): Adaptor region of the pan degenerate sense primer that adapts the probe-binding site upstream of codon 20 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ctttggcarcgaccmnthgtydcartaarrrtagrrggvcaactan

SEQ ID NO: 9982 - DNA, 45 bp, Artificial Sequence
  Pan degenerate oligonucleotide primer
  primer_bind (1)..(45)
  misc_feature (7)..(7): n is a, c, g, or t
  misc_feature (39)..(45): Adaptor region of the pan degenerate sense primer that adapts the probe-binding site upstream of codon 23 to correspond to the nucleotides in an oligonucleotide probe upstream of the discriminating single nucleotide polymorphism.
cgaccmnthgtydcartaarrrtagrrggvcarhyradrgaagct

SEQ ID NO: 9983 - DNA, 46 bp, Artificial Sequence
  Pan degenerate oligonucleotide primer
  primer_bind (1)..(46)
  misc_feature (7)..(7): n is a, c, g, or t
  misc_feature (39)..(45): Adaptor region of the pan degenerate sense primer that adapts the probe-binding site upstream of codon 23 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
cgaccmnthgtydcartaarrrtagrrggvcarhyradrgaagctn

SEQ ID NO: 9984 - DNA, 45 bp, Artificial Sequence
  Pan degenerate oligonucleotide primer
  primer_bind (1)..(45)
  misc_feature (4)..(4): n is a, c, g, or t
  misc_feature (39)..(45): Adaptor region of the pan degenerate sense primer that adapts the probe-binding site upstream of codon 24 to correspond to the nucleotides in an oligonucleotide probe upstream of the discriminating single nucleotide polymorphism.
ccmnthgtydcartaarrrtagrrggvcarhyradrgargctcta

SEQ ID NO: 9985 - DNA, 46 bp, Artificial Sequence
  Pan degenerate oligonucleotide primer
  primer_bind (1)..(46)
  misc_feature (4)..(4): n is a, c, g, or t
  misc_feature (39)..(45): Adaptor region of the pan degenerate sense primer that adapts the probe-binding site upstream of codon 24 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ccmnthgtydcartaarrrtagrrggvcarhyradrgargctctan

SEQ ID NO: 9986 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 30 to correspond to the nucleotides in an oligonucleotide probe upstream of the discriminating single nucleotide polymorphism.
rtagrrggvcarhyradrgargcyctmttagayacaggagcagat

SEQ ID NO: 9987 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 30 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
rtagrrggvcarhyradrgargcyctmttagayacaggagcagatn

SEQ ID NO: 9988 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 32 to correspond to the nucleotides in an oligonucleotide probe upstream of the discriminating single nucleotide polymorphism.
ggvcarhyradrgargcyctmttagayacaggagcagatgataca

SEQ ID NO: 9989 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 32 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ggvcarhyradrgargcyctmttagayacaggagcagatgatacan

SEQ ID NO: 9990 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 33 to correspond to the nucleotides in an oligonucleotide probe upstream of the discriminating single nucleotide polymorphism.
carhyradrgargcyctmttagayacaggagcagatgatacagta

SEQ ID NO: 9991 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 33 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
carhyradrgargcyctmttagayacaggagcagatgatacagtan

SEQ ID NO: 9992 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 43 to correspond to the nucleotides in an oligonucleotide probe upstream of the discriminating single nucleotide polymorphism.
gcagatgatacagtattagaagahatrrrkttrccaggraaatgg

SEQ ID NO: 9993 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 43 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gcagatgatacagtattagaagahatrrrkttrccaggraaatggn

SEQ ID NO: 9994 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 46 to correspond to the nucleotides in an oligonucleotide probe upstream of the discriminating single nucleotide polymorphism.
acagtattagaagahatrrrkttrccaggraratggaarccaaaa

SEQ ID NO: 9995 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 46 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
acagtattagaagahatrrrkttrccaggraratggaarccaaaan

SEQ ID NO: 9996 - DNA, 40 bp, Artificial Sequence
  Pan degenerate oligonucleotide primer
  primer_bind (1)..(40)
  modified_base (15)..(15): base is a locked nucleic acid
  modified_base (20)..(20): base is a locked nucleic acid
  modified_base (21)..(21): base is a locked nucleic acid
  misc_feature (34)..(40): Adaptor region of the pan degenerate sense primer that adapts the probe-binding site upstream of codon 47 to correspond to the nucleotides in an oligonucleotide probe upstream of the discriminating single nucleotide polymorphism.
agaagahatrrrwttrccaggraratggaaaccaaraatg

SEQ ID NO: 9997 - DNA, 40 bp, Artificial Sequence; identical to SEQ ID NO: 9996
  Pan degenerate oligonucleotide primer
  primer_bind (1)..(40)
  modified_base (15)..(15): base is a locked nucleic acid
  modified_base (21)..(21): base is a locked nucleic acid
  modified_base (26)..(26): base is a locked nucleic acid
  misc_feature (34)..(40): Adaptor region of the pan degenerate sense primer that adapts the probe-binding site upstream of codon 47 to correspond to the nucleotides in an oligonucleotide probe upstream of the discriminating single nucleotide polymorphism.

SEQ ID NO: 9998 - DNA, 40 bp, Artificial Sequence; identical to SEQ ID NO: 9996
  Pan degenerate oligonucleotide primer
  primer_bind (1)..(40)
  modified_base (15)..(15): base is a locked nucleic acid
  modified_base (20)..(20): base is a locked nucleic acid
  modified_base (26)..(26): base is a locked nucleic acid
  misc_feature (34)..(40): Adaptor region of the pan degenerate sense primer that adapts the probe-binding site upstream of codon 47 to correspond to the nucleotides in an oligonucleotide probe upstream of the discriminating single nucleotide polymorphism.

SEQ ID NO: 9999 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (7)..(7): base is a locked nucleic acid
  misc_feature (15)..(21): Adaptor region of the pan degenerate sense primer that adapts the probe-binding site upstream of codon 47 to correspond to the nucleotides in an oligonucleotide probe upstream of the discriminating single nucleotide polymorphism.
ggraratggaaaccaaraatg

SEQ ID NO: 10000 - DNA, 21 bp, Artificial Sequence
  Pan degenerate oligonucleotide primer
  primer_bind (1)..(21)
  modified_base (1)..(1): base is a locked nucleic acid
  modified_base (7)..(7): base is a locked nucleic acid
  modified_base (8)..(8): base is a locked nucleic acid
  misc_feature (15)..(21): Adaptor region of the pan degenerate sense primer that adapts the probe-binding site upstream of codon 47 to correspond to the nucleotides in an oligonucleotide probe upstream of the discriminating single nucleotide polymorphism.
ggraratggaaaccaaraatg

SEQ ID NO: 10001 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (8)..(8): base is a locked nucleic acid
  misc_feature (15)..(21): Adaptor region of the pan degenerate sense primer that adapts the probe-binding site upstream of codon 47 to correspond to the nucleotides in an oligonucleotide probe upstream of the discriminating single nucleotide polymorphism.
ggraratggaaaccaaraatg

SEQ ID NO: 10002 - DNA, 40 bp, Artificial Sequence; identical to SEQ ID NO: 9996
  Pan degenerate oligonucleotide primer
  primer_bind (1)..(40)
  misc_feature (34)..(40): Adaptor region of the pan degenerate sense primer that adapts the probe-binding site upstream of codon 47 to correspond to the nucleotides in an oligonucleotide probe upstream of the discriminating single nucleotide polymorphism.

SEQ ID NO: 10003 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 47 to correspond to the nucleotides in an oligonucleotide probe upstream of the discriminating single nucleotide polymorphism.
ggraratggaaaccaaraatg

SEQ ID NO: 10004 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 47 to correspond to the nucleotides in an oligonucleotide probe upstream of the discriminating single nucleotide polymorphism.
gtattagaagahatrrrkttrccaggraratggaarccaaaaatg

SEQ ID NO: 10005 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 47 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
agaagahatrrrwttrccaggraratggaaaccaaraatgn

SEQ ID NO: 10006 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 47 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
ggraratggaaaccaaraatgn

SEQ ID NO: 10007 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 47 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gtattagaagahatrrrkttrccaggraratggaarccaaaaatgn

SEQ ID NO: 10008 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 48 to correspond to the nucleotides in an oligonucleotide probe upstream of the discriminating single nucleotide polymorphism.
ttagaagahatrrrkttrccaggraratggaarccaaaaatgata

SEQ ID NO: 10009 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 48 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ttagaagahatrrrkttrccaggraratggaarccaaaaatgatan

SEQ ID NO: 10010 - DNA, 40 bp, Artificial Sequence
  Pan degenerate oligonucleotide primer
  primer_bind (1)..(40)
  modified_base (6)..(6): base is a locked nucleic acid
  modified_base (11)..(11): base is a locked nucleic acid
  modified_base (12)..(12): base is a locked nucleic acid
  misc_feature (34)..(40): Adaptor region of the pan degenerate sense primer that adapts the probe-binding site upstream of codon 50 to correspond to the nucleotides in an oligonucleotide probe upstream of the discriminating single nucleotide polymorphism.
rrrwttrccaggraratggaaaccaaraatgataggrgga

SEQ ID NO: 10011 - DNA, 40 bp, Artificial Sequence; identical to SEQ ID NO: 10010
  Pan degenerate oligonucleotide primer
  primer_bind (1)..(40)
  modified_base (6)..(6): base is a locked nucleic acid
  modified_base (12)..(12): base is a locked nucleic acid
  modified_base (17)..(17): base is a locked nucleic acid
  misc_feature (34)..(40): Adaptor region of the pan degenerate sense primer that adapts the probe-binding site upstream of codon 50 to correspond to the nucleotides in an oligonucleotide probe upstream of the discriminating single nucleotide polymorphism.

SEQ ID NO: 10012 - DNA, 40 bp, Artificial Sequence; identical to SEQ ID NO: 10010
  Pan degenerate oligonucleotide primer
  primer_bind (1)..(40)
  modified_base (6)..(6): base is a locked nucleic acid
  modified_base (11)..(11): base is a locked nucleic acid
  modified_base (17)..(17): base is a locked nucleic acid
  misc_feature (34)..(40): Adaptor region of the pan degenerate sense primer that adapts the probe-binding site upstream of codon 50 to correspond to the nucleotides in an oligonucleotide probe upstream of the discriminating single nucleotide polymorphism.

SEQ ID NO: 10013 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (7)..(7): base is a locked nucleic acid
  misc_feature (24)..(30): Adaptor region of the pan degenerate sense primer that adapts the probe-binding site upstream of codon 50 to correspond to the nucleotides in an oligonucleotide probe upstream of the discriminating single nucleotide polymorphism.
ggraratggaaaccaaraatgataggrgga

SEQ ID NO: 10014 - DNA, 30 bp, Artificial Sequence; identical to SEQ ID NO: 10013
  Pan degenerate oligonucleotide primer
  primer_bind (1)..(30)
  modified_base (1)..(1): base is a locked nucleic acid
  modified_base (7)..(7): base is a locked nucleic acid
  modified_base (8)..(8): base is a locked nucleic acid
  misc_feature (24)..(30): Adaptor region of the pan degenerate sense primer that adapts the probe-binding site upstream of codon 50 to correspond to the nucleotides in an oligonucleotide probe upstream of the discriminating single nucleotide polymorphism.

SEQ ID NO: 10015 - DNA, 30 bp, Artificial Sequence; identical to SEQ ID NO: 10013
  Pan degenerate oligonucleotide primer
  primer_bind (1)..(30)
  modified_base (1)..(1): base is a locked nucleic acid
  modified_base (2)..(2): base is a locked nucleic acid
  modified_base (8)..(8): base is a locked nucleic acid
  misc_feature (24)..(30): Adaptor region of the pan degenerate sense primer that adapts the probe-binding site upstream of codon 50 to correspond to the nucleotides in an oligonucleotide probe upstream of the discriminating single nucleotide polymorphism.

SEQ ID NO: 10016 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate sense primer that adapts the probe-binding site upstream of codon 50 to correspond to the nucleotides in an oligonucleotide probe upstream of the discriminating single nucleotide polymorphism.
graratggaaaccaaraatgataggrgga

SEQ ID NO: 10017 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (8)..(8): base is a locked nucleic acid
  misc_feature (23)..(29): Adaptor region of the pan degenerate sense primer that adapts the probe-binding site upstream of codon 50 to correspond to the nucleotides in an oligonucleotide probe upstream of the discriminating single nucleotide polymorphism.
graratggaaaccaaraatgataggrgga

SEQ ID NO: 10018 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (8)..(8): base is a locked nucleic acid
  misc_feature (23)..(29): Adaptor region of the pan degenerate sense primer that adapts the probe-binding site upstream of codon 50 to correspond to the nucleotides in an oligonucleotide probe upstream of the discriminating single nucleotide polymorphism.
graratggaaaccaaraatgataggrgga

SEQ ID NO: 10019 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (3)..(3): base is a locked nucleic acid
  misc_feature (18)..(24): Adaptor region of the pan degenerate sense primer that adapts the probe-binding site upstream of codon 50 to correspond to the nucleotides in an oligonucleotide probe upstream of the discriminating single nucleotide polymorphism.
tggaaaccaaraatgataggrgga

SEQ ID NO: 10020 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (4)..(4): base is a locked nucleic acid
  misc_feature (18)..(24): Adaptor region of the pan degenerate sense primer that adapts the probe-binding site upstream of codon 50 to correspond to the nucleotides in an oligonucleotide probe upstream of the discriminating single nucleotide polymorphism.
tggaaaccaaraatgataggrgga

SEQ ID NO: 10021 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate sense primer that adapts the probe-binding site upstream of codon 50 to correspond to the nucleotides in an oligonucleotide probe upstream of the discriminating single nucleotide polymorphism.
tggaaaccaaraatgataggrgga

SEQ ID NO: 10022 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (3)..(3): base is a locked nucleic acid
  misc_feature (17)..(23): Adaptor region of the pan degenerate sense primer that adapts the probe-binding site upstream of codon 50 to correspond to the nucleotides in an oligonucleotide probe upstream of the discriminating single nucleotide polymorphism.
ggaaaccaaraatgataggrgga

SEQ ID NO: 10023 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (6)..(6): base is a locked nucleic acid
  misc_feature (17)..(23): Adaptor region of the pan degenerate sense primer that adapts the probe-binding site upstream of codon 50 to correspond to the nucleotides in an oligonucleotide probe upstream of the discriminating single nucleotide polymorphism.
ggaaaccaaraatgataggrgga

SEQ ID NO: 10024 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (6)..(6): base is a locked nucleic acid
  misc_feature (17)..(23): Adaptor region of the pan degenerate sense primer that adapts the probe-binding site upstream of codon 50 to correspond to the nucleotides in an oligonucleotide probe upstream of the discriminating single nucleotide polymorphism.
ggaaaccaaraatgataggrgga

SEQ ID NO: 10025 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (5)..(5): base is a locked nucleic acid
  misc_feature (16)..(22): Adaptor region of the pan degenerate sense primer that adapts the probe-binding site upstream of codon 50 to correspond to the nucleotides in an oligonucleotide probe upstream of the discriminating single nucleotide polymorphism.
gaaaccaaraatgataggrgga

SEQ ID NO: 10026 - DNA, 22 bp, Artificial Sequence
  Pan degenerate oligonucleotide primer
  primer_bind (1)..(22)
  modified_base (1)..(1): base is a locked nucleic acid
  modified_base (5)..(5): base is a locked nucleic acid
  modified_base (6)..(6): base is a locked nucleic acid
  misc_feature (16)..(22): Adaptor region of the pan degenerate sense primer that adapts the probe-binding site upstream of codon 50 to correspond to the nucleotides in an oligonucleotide probe upstream of the discriminating single nucleotide polymorphism.
gaaaccaaraatgataggrgga

SEQ ID NO: 10027 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (6)..(6): base is a locked nucleic acid
  misc_feature (16)..(22): Adaptor region of the pan degenerate sense primer that adapts the probe-binding site upstream of codon 50 to correspond to the nucleotides in an oligonucleotide probe upstream of the discriminating single nucleotide polymorphism.
gaaaccaaraatgataggrgga

SEQ ID NO: 10028 - DNA, 40 bp, Artificial Sequence; identical to SEQ ID NO: 10010
  Pan degenerate oligonucleotide primer
  primer_bind (1)..(40)
  misc_feature (34)..(40): Adaptor region of the pan degenerate sense primer that adapts the probe-binding site upstream of codon 50 to correspond to the nucleotides in an oligonucleotide probe upstream of the discriminating single nucleotide polymorphism.

SEQ ID NO: 10029 - DNA, 30 bp, Artificial Sequence; identical to SEQ ID NO: 10013
  Pan degenerate oligonucleotide primer
  primer_bind (1)..(30)
  misc_feature (24)..(30): Adaptor region of the pan degenerate sense primer that adapts the probe-binding site upstream of codon 50 to correspond to the nucleotides in an oligonucleotide probe upstream of the discriminating single nucleotide polymorphism.

SEQ ID NO: 10030 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 50 to correspond to the nucleotides in an oligonucleotide probe upstream of the discriminating single nucleotide polymorphism.
graratggaaaccaaraatgataggrgga

SEQ ID NO: 10031 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 50 to correspond to the nucleotides in an oligonucleotide probe upstream of the discriminating single nucleotide polymorphism.
tggaaaccaaraatgataggrgga

SEQ ID NO: 10032 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 50 to correspond to the nucleotides in an oligonucleotide probe upstream of the discriminating single nucleotide polymorphism.
ggaaaccaaraatgataggrgga

SEQ ID NO: 10033 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 50 to correspond to the nucleotides in an oligonucleotide probe upstream of the discriminating single nucleotide polymorphism.
gaaaccaaraatgataggrgga

SEQ ID NO: 10034 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 50 to correspond to the nucleotides in an oligonucleotide probe upstream of the discriminating single nucleotide polymorphism.
gahatrrrkttrccaggraratggaarccaaaaatrataggggga

SEQ ID NO: 10035 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 50 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rrrwttrccaggraratggaaaccaaraatgataggrggan

SEQ ID NO: 10036 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 50 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
ggraratggaaaccaaraatgataggrggan

SEQ ID NO: 10037 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 50 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
graratggaaaccaaraatgataggrggan

SEQ ID NO: 10038 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 50 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
tggaaaccaaraatgataggrggan

SEQ ID NO: 10039 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 50 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
ggaaaccaaraatgataggrggan

SEQ ID NO: 10040 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 50 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
gaaaccaaraatgataggrggan

SEQ ID NO: 10041 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 50 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gahatrrrkttrccaggraratggaarccaaaaatratagggggan

SEQ ID NO: 10042 - DNA, 40 bp, Artificial Sequence
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.
graratggaaaccaaraatgataggrggaattggaggytt

SEQ ID NO: 10043 - DNA, 40 bp, Artificial Sequence; identical to SEQ ID NO: 10042
  Pan degenerate oligonucleotide primer
  primer_bind (1)..(40)
  modified_base (1)..(1): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10044 - DNA, 40 bp, Artificial Sequence; identical to SEQ ID NO: 10042
  Pan degenerate oligonucleotide primer
  primer_bind (1)..(40)
  modified_base (1)..(1): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10045 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (3)..(3): base is a locked nucleic acid
  misc_feature (29)..(35): Adaptor region of the pan degenerate sense primer that adapts the probe-binding site upstream of codon 53 to correspond to the nucleotides in an oligonucleotide probe upstream of the discriminating single nucleotide polymorphism.
tggaaaccaaraatgataggrggaattggaggytt

SEQ ID NO: 10046 - DNA, 35 bp, Artificial Sequence; identical to SEQ ID NO: 10045
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10047 - DNA, 35 bp, Artificial Sequence; identical to SEQ ID NO: 10045
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10048 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (3)..(3): base is a locked nucleic acid
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.
ggaaaccaaraatgataggrggaattggaggytt

SEQ ID NO: 10049 - DNA, 34 bp, Artificial Sequence; identical to SEQ ID NO: 10048
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10050 - DNA, 34 bp, Artificial Sequence; identical to SEQ ID NO: 10048
  Pan degenerate oligonucleotide primer
  primer_bind (1)..(34)
  modified_base (1)..(1): base is a locked nucleic acid
  modified_base (2)..(2): base is a locked nucleic acid
  modified_base (6)..(6): base is a locked nucleic acid
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10051 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.
gaaaccaaraatgataggrggaattggaggytt

SEQ ID NO: 10052 - DNA, 33 bp, Artificial Sequence; identical to SEQ ID NO: 10051
  Pan degenerate oligonucleotide primer
  primer_bind (1)..(33)
  modified_base (1)..(1): base is a locked nucleic acid
  modified_base (5)..(5): base is a locked nucleic acid
  modified_base (6)..(6): base is a locked nucleic acid
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10053 - DNA, 33 bp, Artificial Sequence; identical to SEQ ID NO: 10051
  Pan degenerate oligonucleotide primer
  primer_bind (1)..(33)
  modified_base (1)..(1): base is a locked nucleic acid
  modified_base (2)..(2): base is a locked nucleic acid
  modified_base (6)..(6): base is a locked nucleic acid
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10054 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.
aaaccaaraatgataggrggaattggaggytt

SEQ ID NO: 10055 - DNA, 32 bp, Artificial Sequence; identical to SEQ ID NO: 10054
  Pan degenerate oligonucleotide primer
  primer_bind (1)..(32)
  modified_base (1)..(1): base is a locked nucleic acid
  modified_base (5)..(5): base is a locked nucleic acid
  modified_base (7)..(7): base is a locked nucleic acid
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10056 - DNA, 32 bp, Artificial Sequence; identical to SEQ ID NO: 10054
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10057 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate sense primer that adapts the probe-binding site upstream of codon 53 to correspond to the nucleotides in an oligonucleotide probe upstream of the discriminating single nucleotide polymorphism.
ccaaraatgataggrggaattggaggytt

SEQ ID NO: 10058 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (8)..(8): base is a locked nucleic acid
  misc_feature (23)..(29): Adaptor region of the pan degenerate sense primer that adapts the probe-binding site upstream of codon 53 to correspond to the nucleotides in an oligonucleotide probe upstream of the discriminating single nucleotide polymorphism.
ccaaraatgataggrggaattggaggytt

SEQ ID NO: 10059 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (8)..(8): base is a locked nucleic acid
  misc_feature (23)..(29): Adaptor region of the pan degenerate sense primer that adapts the probe-binding site upstream of codon 53 to correspond to the nucleotides in an oligonucleotide probe upstream of the discriminating single nucleotide polymorphism.
ccaaraatgataggrggaattggaggytt

SEQ ID NO: 10060 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (7)..(7): base is a locked nucleic acid
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.
ggraratggaaaccaaraatgataggrggaattggaggyt

SEQ ID NO: 10061 - DNA, 40 bp, Artificial Sequence; identical to SEQ ID NO: 10060
  Pan degenerate oligonucleotide primer
  primer_bind (1)..(40)
  modified_base (1)..(1): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10062 - DNA, 40 bp, Artificial Sequence; identical to SEQ ID NO: 10060
  Pan degenerate oligonucleotide primer
  primer_bind (1)..(40)
  modified_base (1)..(1): base is a locked nucleic acid
  modified_base (2)..(2): base is a locked nucleic acid
  modified_base (8)..(8): base is a locked nucleic acid
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10063 - DNA, 39 bp, Artificial Sequence
  Pan degenerate oligonucleotide primer
  primer_bind (1)..(39)
  modified_base (1)..(1): base is a locked nucleic acid
  modified_base (6)..(6): base is a locked nucleic acid
  modified_base (7)..(7): base is a locked nucleic acid
  misc_feature (33)..(39): Adaptor region of the pan degenerate sense primer that adapts the probe-binding site upstream of codon 53 to correspond to the nucleotides in an oligonucleotide probe upstream of the discriminating single nucleotide polymorphism.
graratggaaaccaaraatgataggrggaattggaggyt

SEQ ID NO: 10064 - DNA, 39 bp, Artificial Sequence; identical to SEQ ID NO: 10063
  Pan degenerate oligonucleotide primer
  primer_bind (1)..(39)
  modified_base (1)..(1): base is a locked nucleic acid
  modified_base (7)..(7): base is a locked nucleic acid
  modified_base (8)..(8): base is a locked nucleic acid
  misc_feature (33)..(39): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10065 - DNA, 39 bp, Artificial Sequence; identical to SEQ ID NO: 10063
  Pan degenerate oligonucleotide primer
  primer_bind (1)..(39)
  modified_base (1)..(1): base is a locked nucleic acid
  modified_base (6)..(6): base is a locked nucleic acid
  modified_base (8)..(8): base is a locked nucleic acid
  misc_feature (33)..(39): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10066 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (3)..(3): base is a locked nucleic acid
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.
tggaaaccaaraatgataggrggaattggaggyt

SEQ ID NO: 10067 - DNA, 34 bp, Artificial Sequence; identical to SEQ ID NO: 10066
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10068 - DNA, 34 bp, Artificial Sequence; identical to SEQ ID NO: 10066
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10069 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (3)..(3): base is a locked nucleic acid
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.
ggaaaccaaraatgataggrggaattggaggyt

SEQ ID NO: 10070 - DNA, 33 bp, Artificial Sequence; identical to SEQ ID NO: 10069
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10071 - DNA, 33 bp, Artificial Sequence; identical to SEQ ID NO: 10069
  Pan degenerate oligonucleotide primer
  primer_bind (1)..(33)
  modified_base (1)..(1): base is a locked nucleic acid
  modified_base (2)..(2): base is a locked nucleic acid
  modified_base (6)..(6): base is a locked nucleic acid
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10072 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.
gaaaccaaraatgataggrggaattggaggyt

SEQ ID NO: 10073 - DNA, 32 bp, Artificial Sequence; identical to SEQ ID NO: 10072
  Pan degenerate oligonucleotide primer
  primer_bind (1)..(32)
  modified_base (1)..(1): base is a locked nucleic acid
  modified_base (5)..(5): base is a locked nucleic acid
  modified_base (6)..(6): base is a locked nucleic acid
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10074 - DNA, 32 bp, Artificial Sequence; identical to SEQ ID NO: 10072
  Pan degenerate oligonucleotide primer
  primer_bind (1)..(32)
  modified_base (1)..(1): base is a locked nucleic acid
  modified_base (2)..(2): base is a locked nucleic acid
  modified_base (6)..(6): base is a locked nucleic acid
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10075 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (5)..(5): base is a locked nucleic acid
  misc_feature (25)..(31): Adaptor region of the pan degenerate sense primer that adapts the probe-binding site upstream of codon 53 to correspond to the nucleotides in an oligonucleotide probe upstream of the discriminating single nucleotide polymorphism.
aaaccaaraatgataggrggaattggaggyt

SEQ ID NO: 10076 - DNA, 31 bp, Artificial Sequence; identical to SEQ ID NO: 10075
  Pan degenerate oligonucleotide primer
  primer_bind (1)..(31)
  modified_base (1)..(1): base is a locked nucleic acid
  modified_base (5)..(5): base is a locked nucleic acid
  modified_base (7)..(7): base is a locked nucleic acid
  misc_feature (25)..(31): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10077 - DNA, 31 bp, Artificial Sequence; identical to SEQ ID NO: 10075
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10078 - DNA, 40 bp, Artificial Sequence; identical to SEQ ID NO: 10042
  Pan degenerate oligonucleotide primer
  primer_bind (1)..(40)
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10079 - DNA, 35 bp, Artificial Sequence; identical to SEQ ID NO: 10045
  Pan degenerate oligonucleotide primer
  primer_bind (1)..(35)
  misc_feature (29)..(35): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10080 - DNA, 34 bp, Artificial Sequence; identical to SEQ ID NO: 10048
  Pan degenerate oligonucleotide primer
  primer_bind (1)..(34)
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10081 - DNA, 33 bp, Artificial Sequence; identical to SEQ ID NO: 10051
  Pan degenerate oligonucleotide primer
  primer_bind (1)..(33)
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10082 - DNA, 32 bp, Artificial Sequence; identical to SEQ ID NO: 10054
  Pan degenerate oligonucleotide primer
  primer_bind (1)..(32)
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10083 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 53 to correspond to the nucleotides in an oligonucleotide probe upstream of the discriminating single nucleotide polymorphism.
ccaaraatgataggrggaattggaggytt

SEQ ID NO: 10084 - DNA, 40 bp, Artificial Sequence; identical to SEQ ID NO: 10060
  Pan degenerate oligonucleotide primer
  primer_bind (1)..(40)
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10085 - DNA, 39 bp, Artificial Sequence; identical to SEQ ID NO: 10063
  Pan degenerate oligonucleotide primer
  primer_bind (1)..(39)
  misc_feature (33)..(39): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10086 - DNA, 34 bp, Artificial Sequence; identical to SEQ ID NO: 10066
  Pan degenerate oligonucleotide primer
  primer_bind (1)..(34)
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10087 - DNA, 33 bp, Artificial Sequence; identical to SEQ ID NO: 10069
  Pan degenerate oligonucleotide primer
  primer_bind (1)..(33)
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10088 - DNA, 32 bp, Artificial Sequence; identical to SEQ ID NO: 10072
  Pan degenerate oligonucleotide primer
  primer_bind (1)..(32)
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10089 - DNA, 31 bp, Artificial Sequence; identical to SEQ ID NO: 10075
  Pan degenerate oligonucleotide primer
  primer_bind (1)..(31)
  misc_feature (25)..(31): Adaptor region of the pan degenerate sense primer that adapts the probe-binding site upstream of codon 53 to correspond to the nucleotides in an oligonucleotide probe upstream of the discriminating single nucleotide polymorphism.

SEQ ID NO: 10090 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 53 to correspond to the nucleotides in an oligonucleotide probe upstream of the discriminating single nucleotide polymorphism.
ttrccaggraratggaarccaaaaatrataggrggaattggaggt

SEQ ID NO: 10091 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
graratggaaaccaaraatgataggrggaattggaggyttn

SEQ ID NO: 10092 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 53 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
tggaaaccaaraatgataggrggaattggaggyttn

SEQ ID NO: 10093 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ggaaaccaaraatgataggrggaattggaggyttn

SEQ ID NO: 10094 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
gaaaccaaraatgataggrggaattggaggyttn

SEQ ID NO: 10095 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
aaaccaaraatgataggrggaattggaggyttn

SEQ ID NO: 10096 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 53 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
ccaaraatgataggrggaattggaggyttn

SEQ ID NO: 10097 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 53 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ggraratggaaaccaaraatgataggrggaattggaggytn

SEQ ID NO: 10098 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 53 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
graratggaaaccaaraatgataggrggaattggaggytn

SEQ ID NO: 10099 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 53 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
tggaaaccaaraatgataggrggaattggaggytn

SEQ ID NO: 10100 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 53 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ggaaaccaaraatgataggrggaattggaggytn

SEQ ID NO: 10101 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 53 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
gaaaccaaraatgataggrggaattggaggytn

SEQ ID NO: 10102 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 53 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
aaaccaaraatgataggrggaattggaggytn

SEQ ID NO: 10103 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 53 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ttrccaggraratggaarccaaaaatrataggrggaattggaggtn

SEQ ID NO: 10104 - DNA, 40 bp, Artificial Sequence
  Pan degenerate oligonucleotide primer
  primer_bind (1)..(40)
  modified_base (3)..(3): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.
ratggaaaccaaraatgataggrggaattggaggytttat

SEQ ID NO: 10105 - DNA, 40 bp, Artificial Sequence; identical to SEQ ID NO: 10104
  Pan degenerate oligonucleotide primer
  primer_bind (1)..(40)
  modified_base (3)..(3): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10106 - DNA, 40 bp, Artificial Sequence; identical to SEQ ID NO: 10104
  Pan degenerate oligonucleotide primer
  primer_bind (1)..(40)
  modified_base (3)..(3): base is a locked nucleic acid
  modified_base (4)..(4): base is a locked nucleic acid
  modified_base (6)..(6): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10107 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (3)..(3): base is a locked nucleic acid
  misc_feature (31)..(37): Adaptor region of the pan degenerate sense primer that adapts the probe-binding site upstream of codon 54 to correspond to the nucleotides in an oligonucleotide probe upstream of the discriminating single nucleotide polymorphism.
ggaaaccaaraatgataggrggaattggaggytttat

SEQ ID NO: 10108 - DNA, 37 bp, Artificial Sequence; identical to SEQ ID NO: 10107
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10109 - DNA, 37 bp, Artificial Sequence; identical to SEQ ID NO: 10107
  Pan degenerate oligonucleotide primer
  primer_bind (1)..(37)
  modified_base (1)..(1): base is a locked nucleic acid
  modified_base (2)..(2): base is a locked nucleic acid
  modified_base (6)..(6): base is a locked nucleic acid
  misc_feature (31)..(37): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10110 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.
gaaaccaaraatgataggrggaattggaggytttat

SEQ ID NO: 10111 - DNA, 36 bp, Artificial Sequence; identical to SEQ ID NO: 10110
  Pan degenerate oligonucleotide primer
  primer_bind (1)..(36)
  modified_base (1)..(1): base is a locked nucleic acid
  modified_base (5)..(5): base is a locked nucleic acid
  modified_base (6)..(6): base is a locked nucleic acid
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10112 - DNA, 36 bp, Artificial Sequence; identical to SEQ ID NO: 10110
  Pan degenerate oligonucleotide primer
  primer_bind (1)..(36)
  modified_base (1)..(1): base is a locked nucleic acid
  modified_base (2)..(2): base is a locked nucleic acid
  modified_base (6)..(6): base is a locked nucleic acid
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10113 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.
aaaccaaraatgataggrggaattggaggytttat

SEQ ID NO: 10114 - DNA, 35 bp, Artificial Sequence; identical to SEQ ID NO: 10113
  Pan degenerate oligonucleotide primer
  primer_bind (1)..(35)
  modified_base (1)..(1): base is a locked nucleic acid
  modified_base (5)..(5): base is a locked nucleic acid
  modified_base (7)..(7): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10115 - DNA, 35 bp, Artificial Sequence; identical to SEQ ID NO: 10113
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10116 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate sense primer that adapts the probe-binding site upstream of codon 54 to correspond to the nucleotides in an oligonucleotide probe upstream of the discriminating single nucleotide polymorphism.
ccaaraatgataggrggaattggaggytttat

SEQ ID NO: 10117 - DNA, 32 bp, Artificial Sequence; identical to SEQ ID NO: 10116
  Pan degenerate oligonucleotide primer
  primer_bind (1)..(32)
  modified_base (1)..(1): base is a locked nucleic acid
  modified_base (4)..(4): base is a locked nucleic acid
  modified_base (8)..(8): base is a locked nucleic acid
  misc_feature (26)..(32): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10118 - DNA, 32 bp, Artificial Sequence; identical to SEQ ID NO: 10116
  Pan degenerate oligonucleotide primer
  primer_bind (1)..(32)
  modified_base (1)..(1): base is a locked nucleic acid
  modified_base (2)..(2): base is a locked nucleic acid
  modified_base (8)..(8): base is a locked nucleic acid
  misc_feature (26)..(32): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10119 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (7)..(7): base is a locked nucleic acid
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.
caaraatgataggrggaattggaggytttat

SEQ ID NO: 10120 - DNA, 31 bp, Artificial Sequence; identical to SEQ ID NO: 10119
  Pan degenerate oligonucleotide primer
  primer_bind (1)..(31)
  modified_base (1)..(1): base is a locked nucleic acid
  modified_base (7)..(7): base is a locked nucleic acid
  modified_base (9)..(9): base is a locked nucleic acid
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10121 - DNA, 31 bp, Artificial Sequence; identical to SEQ ID NO: 10119
  Pan degenerate oligonucleotide primer
  primer_bind (1)..(31)
  modified_base (1)..(1): base is a locked nucleic acid
  modified_base (3)..(3): base is a locked nucleic acid
  modified_base (9)..(9): base is a locked nucleic acid
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10122 - DNA, 40 bp, Artificial Sequence
  Pan degenerate oligonucleotide primer
  primer_bind (1)..(40)
  modified_base (4)..(4): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.
aratggaaaccaaraatgataggrggaattggaggyttta

SEQ ID NO: 10123 - DNA, 40 bp, Artificial Sequence; identical to SEQ ID NO: 10122
  Pan degenerate oligonucleotide primer
  primer_bind (1)..(40)
  modified_base (4)..(4): base is a locked nucleic acid
  modified_base (6)..(6): base is a locked nucleic acid
  modified_base (7)..(7): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10124 - DNA, 40 bp, Artificial Sequence; identical to SEQ ID NO: 10122
  Pan degenerate oligonucleotide primer
  primer_bind (1)..(40)
  modified_base (4)..(4): base is a locked nucleic acid
  modified_base (5)..(5): base is a locked nucleic acid
  modified_base (7)..(7): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10125 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (3)..(3): base is a locked nucleic acid
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.
ggaaaccaaraatgataggrggaattggaggyttta

SEQ ID NO: 10126 - DNA, 36 bp, Artificial Sequence; identical to SEQ ID NO: 10125
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10127 - DNA, 36 bp, Artificial Sequence; identical to SEQ ID NO: 10125
  Pan degenerate oligonucleotide primer
  primer_bind (1)..(36)
  modified_base (1)..(1): base is a locked nucleic acid
  modified_base (2)..(2): base is a locked nucleic acid
  modified_base (6)..(6): base is a locked nucleic acid
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10128 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.
gaaaccaaraatgataggrggaattggaggyttta

SEQ ID NO: 10129 - DNA, 35 bp, Artificial Sequence; identical to SEQ ID NO: 10128
  Pan degenerate oligonucleotide primer
  primer_bind (1)..(35)
  modified_base (1)..(1): base is a locked nucleic acid
  modified_base (5)..(5): base is a locked nucleic acid
  modified_base (6)..(6): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10130 - DNA, 35 bp, Artificial Sequence; identical to SEQ ID NO: 10128
  Pan degenerate oligonucleotide primer
  primer_bind (1)..(35)
  modified_base (1)..(1): base is a locked nucleic acid
  modified_base (2)..(2): base is a locked nucleic acid
  modified_base (6)..(6): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10131 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.
aaaccaaraatgataggrggaattggaggyttta

SEQ ID NO: 10132 - DNA, 34 bp, Artificial Sequence; identical to SEQ ID NO: 10131
  Pan degenerate oligonucleotide primer
  primer_bind (1)..(34)
  modified_base (1)..(1): base is a locked nucleic acid
  modified_base (5)..(5): base is a locked nucleic acid
  modified_base (7)..(7): base is a locked nucleic acid
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10133 - DNA, 34 bp, Artificial Sequence; identical to SEQ ID NO: 10131
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10134 - DNA, 31 bp, Artificial Sequence
  Pan degenerate oligonucleotide primer
  primer_bind (1)..(31)
  modified_base (1)..(1): base is a locked nucleic acid
  modified_base (2)..(2): base is a locked nucleic acid
  modified_base (4)..(4): base is a locked nucleic acid
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.
ccaaraatgataggrggaattggaggyttta

SEQ ID NO: 10135 - DNA, 31 bp, Artificial Sequence; identical to SEQ ID NO: 10134
  Pan degenerate oligonucleotide primer
  primer_bind (1)..(31)
  modified_base (1)..(1): base is a locked nucleic acid
  modified_base (4)..(4): base is a locked nucleic acid
  modified_base (8)..(8): base is a locked nucleic acid
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10136 - DNA, 31 bp, Artificial Sequence; identical to SEQ ID NO: 10134
  Pan degenerate oligonucleotide primer
  primer_bind (1)..(31)
  modified_base (1)..(1): base is a locked nucleic acid
  modified_base (2)..(2): base is a locked nucleic acid
  modified_base (8)..(8): base is a locked nucleic acid
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10137 - DNA, 30 bp, Artificial Sequence
  Pan degenerate oligonucleotide primer
  primer_bind (1)..(30)
  modified_base (1)..(1): base is a locked nucleic acid
  modified_base (3)..(3): base is a locked nucleic acid
  modified_base (7)..(7): base is a locked nucleic acid
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.
caaraatgataggrggaattggaggyttta

SEQ ID NO: 10138 - DNA, 30 bp, Artificial Sequence; identical to SEQ ID NO: 10137
  Pan degenerate oligonucleotide primer
  primer_bind (1)..(30)
  modified_base (1)..(1): base is a locked nucleic acid
  modified_base (7)..(7): base is a locked nucleic acid
  modified_base (9)..(9): base is a locked nucleic acid
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10139 - DNA, 30 bp, Artificial Sequence; identical to SEQ ID NO: 10137
  Pan degenerate oligonucleotide primer
  primer_bind (1)..(30)
  modified_base (1)..(1): base is a locked nucleic acid
  modified_base (3)..(3): base is a locked nucleic acid
  modified_base (9)..(9): base is a locked nucleic acid
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10140 - DNA, 40 bp, Artificial Sequence
  Pan degenerate oligonucleotide primer
  primer_bind (1)..(40)
  modified_base (5)..(5): base is a locked nucleic acid
  modified_base (6)..(6): base is a locked nucleic acid
  modified_base (7)..(7): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.
raratggaaaccaaraatgataggrggaattggaggyttt

SEQ ID NO: 10141 - DNA, 40 bp, Artificial Sequence; identical to SEQ ID NO: 10140
  Pan degenerate oligonucleotide primer
  primer_bind (1)..(40)
  modified_base (5)..(5): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10142 - DNA, 40 bp, Artificial Sequence; identical to SEQ ID NO: 10140
  Pan degenerate oligonucleotide primer
  primer_bind (1)..(40)
  modified_base (5)..(5): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10143 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (3)..(3): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.
ggaaaccaaraatgataggrggaattggaggyttt

SEQ ID NO: 10144 - DNA, 35 bp, Artificial Sequence; identical to SEQ ID NO: 10143
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10145 - DNA, 35 bp, Artificial Sequence; identical to SEQ ID NO: 10143
  Pan degenerate oligonucleotide primer
  primer_bind (1)..(35)
  modified_base (1)..(1): base is a locked nucleic acid
  modified_base (2)..(2): base is a locked nucleic acid
  modified_base (6)..(6): base is a locked nucleic acid
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10146 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.
gaaaccaaraatgataggrggaattggaggyttt

SEQ ID NO: 10147 - DNA, 34 bp, Artificial Sequence; identical to SEQ ID NO: 10146
  Pan degenerate oligonucleotide primer
  primer_bind (1)..(34)
  modified_base (1)..(1): base is a locked nucleic acid
  modified_base (5)..(5): base is a locked nucleic acid
  modified_base (6)..(6): base is a locked nucleic acid
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10148 - DNA, 34 bp, Artificial Sequence; identical to SEQ ID NO: 10146
  Pan degenerate oligonucleotide primer
  primer_bind (1)..(34)
  modified_base (1)..(1): base is a locked nucleic acid
  modified_base (2)..(2): base is a locked nucleic acid
  modified_base (6)..(6): base is a locked nucleic acid
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10149 - DNA, 33 bp, Artificial Sequence
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 54 to correspond to the nucleotides in an oligonucleotide probe upstream of the discriminating single nucleotide polymorphism.
aaaccaaraatgataggrggaattggaggyttt

SEQ ID NO: 10150 - DNA, 33 bp, Artificial Sequence; identical to SEQ ID NO: 10149
  Pan degenerate oligonucleotide primer
  primer_bind (1)..(33)
  modified_base (1)..(1): base is a locked nucleic acid
  modified_base (5)..(5): base is a locked nucleic acid
  modified_base (7)..(7): base is a locked nucleic acid
  misc_feature (27)..(33): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10151 - DNA, 33 bp, Artificial Sequence; identical to SEQ ID NO: 10149
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10152 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.
ccaaraatgataggrggaattggaggyttt

SEQ ID NO: 10153 - DNA, 30 bp, Artificial Sequence; identical to SEQ ID NO: 10152
  Pan degenerate oligonucleotide primer
  primer_bind (1)..(30)
  modified_base (1)..(1): base is a locked nucleic acid
  modified_base (4)..(4): base is a locked nucleic acid
  modified_base (8)..(8): base is a locked nucleic acid
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10154 - DNA, 30 bp, Artificial Sequence; identical to SEQ ID NO: 10152
  Pan degenerate oligonucleotide primer
  primer_bind (1)..(30)
  modified_base (1)..(1): base is a locked nucleic acid
  modified_base (2)..(2): base is a locked nucleic acid
  modified_base (8)..(8): base is a locked nucleic acid
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10155 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (7)..(7): base is a locked nucleic acid
  misc_feature (23)..(29): Adaptor region of the pan degenerate sense primer that adapts the probe-binding site upstream of codon 54 to correspond to the nucleotides in an oligonucleotide probe upstream of the discriminating single nucleotide polymorphism.
caaraatgataggrggaattggaggyttt

SEQ ID NO: 10156 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (9)..(9): base is a locked nucleic acid
  misc_feature (23)..(29): Adaptor region of the pan degenerate sense primer that adapts the probe-binding site upstream of codon 54 to correspond to the nucleotides in an oligonucleotide probe upstream of the discriminating single nucleotide polymorphism.
caaraatgataggrggaattggaggyttt

SEQ ID NO: 10157 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (9)..(9): base is a locked nucleic acid
  misc_feature (23)..(29): Adaptor region of the pan degenerate sense primer that adapts the probe-binding site upstream of codon 54 to correspond to the nucleotides in an oligonucleotide probe upstream of the discriminating single nucleotide polymorphism.
caaraatgataggrggaattggaggyttt

SEQ ID NO: 10158 - DNA, 40 bp, Artificial Sequence; identical to SEQ ID NO: 10104
  Pan degenerate oligonucleotide primer
  primer_bind (1)..(40)
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10159 - DNA, 37 bp, Artificial Sequence; identical to SEQ ID NO: 10107
  Pan degenerate oligonucleotide primer
  primer_bind (1)..(37)
  misc_feature (31)..(37): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10160 - DNA, 36 bp, Artificial Sequence; identical to SEQ ID NO: 10110
  Pan degenerate oligonucleotide primer
  primer_bind (1)..(36)
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10161 - DNA, 35 bp, Artificial Sequence; identical to SEQ ID NO: 10113
  Pan degenerate oligonucleotide primer
  primer_bind (1)..(35)
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10162 - DNA, 32 bp, Artificial Sequence; identical to SEQ ID NO: 10116
  Pan degenerate oligonucleotide primer
  primer_bind (1)..(32)
  misc_feature (26)..(32): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10163 - DNA, 31 bp, Artificial Sequence; identical to SEQ ID NO: 10119
  Pan degenerate oligonucleotide primer
  primer_bind (1)..(31)
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10164 - DNA, 40 bp, Artificial Sequence; identical to SEQ ID NO: 10122
  Pan degenerate oligonucleotide primer
  primer_bind (1)..(40)
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10165 - DNA, 36 bp, Artificial Sequence; identical to SEQ ID NO: 10125
  Pan degenerate oligonucleotide primer
  primer_bind (1)..(36)
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10166 - DNA, 35 bp, Artificial Sequence; identical to SEQ ID NO: 10128
  Pan degenerate oligonucleotide primer
  primer_bind (1)..(35)
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10167 - DNA, 34 bp, Artificial Sequence; identical to SEQ ID NO: 10131
  Pan degenerate oligonucleotide primer
  primer_bind (1)..(34)
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10168 - DNA, 31 bp, Artificial Sequence; identical to SEQ ID NO: 10134
  Pan degenerate oligonucleotide primer
  primer_bind (1)..(31)
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10169 - DNA, 30 bp, Artificial Sequence; identical to SEQ ID NO: 10137
  Pan degenerate oligonucleotide primer
  primer_bind (1)..(30)
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10170 - DNA, 40 bp, Artificial Sequence; identical to SEQ ID NO: 10140
  Pan degenerate oligonucleotide primer
  primer_bind (1)..(40)
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10171 - DNA, 35 bp, Artificial Sequence; identical to SEQ ID NO: 10143
  Pan degenerate oligonucleotide primer
  primer_bind (1)..(35)
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10172 - DNA, 34 bp, Artificial Sequence; identical to SEQ ID NO: 10146
  Pan degenerate oligonucleotide primer
  primer_bind (1)..(34)
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10173 - DNA, 33 bp, Artificial Sequence; identical to SEQ ID NO: 10149
  Pan degenerate oligonucleotide primer
  primer_bind (1)..(33)
  misc_feature (27)..(33): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10174 - DNA, 30 bp, Artificial Sequence; identical to SEQ ID NO: 10152
  Pan degenerate oligonucleotide primer
  primer_bind (1)..(30)
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.

SEQ ID NO: 10175 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 54 to correspond to the nucleotides in an oligonucleotide probe upstream of the discriminating single nucleotide polymorphism.
caaraatgataggrggaattggaggyttt

SEQ ID NO: 10176 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 54 to correspond to the nucleotides in an oligonucleotide probe upstream of the discriminating single nucleotide polymorphism.
ccaggraratggaarccaaaaatrataggrggaattggaggtttt

SEQ ID NO: 10177 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ratggaaaccaaraatgataggrggaattggaggytttatn

SEQ ID NO: 10178 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 54 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ggaaaccaaraatgataggrggaattggaggytttatn

SEQ ID NO: 10179 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
gaaaccaaraatgataggrggaattggaggytttatn

SEQ ID NO: 10180 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
aaaccaaraatgataggrggaattggaggytttatn

SEQ ID NO: 10181 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 54 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
ccaaraatgataggrggaattggaggytttatn

SEQ ID NO: 10182 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
caaraatgataggrggaattggaggytttatn

SEQ ID NO: 10183 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aratggaaaccaaraatgataggrggaattggaggytttan

SEQ ID NO: 10184 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 54 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ggaaaccaaraatgataggrggaattggaggytttan

SEQ ID NO: 10185 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
gaaaccaaraatgataggrggaattggaggytttan

SEQ ID NO: 10186 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
aaaccaaraatgataggrggaattggaggytttan

SEQ ID NO: 10187 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 54 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
ccaaraatgataggrggaattggaggytttan

SEQ ID NO: 10188 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
caaraatgataggrggaattggaggytttan

SEQ ID NO: 10189 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 54 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
raratggaaaccaaraatgataggrggaattggaggytttn

SEQ ID NO: 10190 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 54 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
ggaaaccaaraatgataggrggaattggaggytttn

SEQ ID NO: 10191 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 54 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
gaaaccaaraatgataggrggaattggaggytttn

SEQ ID NO: 10192 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 54 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
aaaccaaraatgataggrggaattggaggytttn

SEQ ID NO: 10193 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 54 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
ccaaraatgataggrggaattggaggytttn

SEQ ID NO: 10194 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 54 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
caaraatgataggrggaattggaggytttn

SEQ ID NO: 10195 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 54 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ccaggraratggaarccaaaaatrataggrggaattggaggttttn

SEQ ID NO: 10196 - DNA, 40 bp, Artificial Sequence
  Pan degenerate oligonucleotide primer
  primer_bind (1)..(40)
  modified_base (2)..(2): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 58 to correspond to the nucleotides in an oligonucleotide probe upstream of the discriminating single nucleotide polymorphism.
aaraatgataggrggaattggaggytttatyaargtaarr

SEQ ID NO: 10197 - DNA, 40 bp, Artificial Sequence; identical to SEQ ID NO: 10196
  Pan degenerate oligonucleotide primer
  primer_bind (1)..(40)
  modified_base (2)..(2): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10198 - DNA, 40 bp, Artificial Sequence; identical to SEQ ID NO: 10196
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10199 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 58 to correspond to the nucleotides in an oligonucleotide probe upstream of the discriminating single nucleotide polymorphism.
tgataggrggaattggaggytttatyaargtaarr

SEQ ID NO: 10200 - DNA, 35 bp, Artificial Sequence; identical to SEQ ID NO: 10199
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10201 - DNA, 35 bp, Artificial Sequence; identical to SEQ ID NO: 10199
  Pan degenerate oligonucleotide primer
  primer_bind (1)..(35)
  modified_base (1)..(1): base is a locked nucleic acid
  modified_base (3)..(3): base is a locked nucleic acid
  modified_base (5)..(5): base is a locked nucleic acid
  misc_feature (29)..(35): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10202 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (3)..(3): base is a locked nucleic acid
  misc_feature (27)..(33): Adaptor region of the pan degenerate sense primer that adapts the probe-binding site upstream of codon 58 to correspond to the nucleotides in an oligonucleotide probe upstream of the discriminating single nucleotide polymorphism.
ataggrggaattggaggytttatyaargtaarr

SEQ ID NO: 10203 - DNA, 33 bp, Artificial Sequence; identical to SEQ ID NO: 10202
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10204 - DNA, 33 bp, Artificial Sequence; identical to SEQ ID NO: 10202
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10205 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (3)..(3): base is a locked nucleic acid
  misc_feature (26)..(32): Adaptor region of the pan degenerate sense primer that adapts the probe-binding site upstream of codon 58 to correspond to the nucleotides in an oligonucleotide probe upstream of the discriminating single nucleotide polymorphism.
taggrggaattggaggytttatyaargtaarr

SEQ ID NO: 10206 - DNA, 32 bp, Artificial Sequence; identical to SEQ ID NO: 10205
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10207 - DNA, 32 bp, Artificial Sequence; identical to SEQ ID NO: 10205
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10208 - DNA, 31 bp, Artificial Sequence
  Pan degenerate oligonucleotide primer
  primer_bind (1)..(31)
  modified_base (1)..(1): base is a locked nucleic acid
  modified_base (2)..(2): base is a locked nucleic acid
  modified_base (3)..(3): base is a locked nucleic acid
  misc_feature (25)..(31): Adaptor region of the pan degenerate sense primer that adapts the probe-binding site upstream of codon 58 to correspond to the nucleotides in an oligonucleotide probe upstream of the discriminating single nucleotide polymorphism.
aggrggaattggaggytttatyaargtaarr

SEQ ID NO: 10209 - DNA, 31 bp, Artificial Sequence; identical to SEQ ID NO: 10208
  Pan degenerate oligonucleotide primer
  primer_bind (1)..(31)
  modified_base (1)..(1): base is a locked nucleic acid
  modified_base (3)..(3): base is a locked nucleic acid
  modified_base (5)..(5): base is a locked nucleic acid
  misc_feature (25)..(31): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10210 - DNA, 31 bp, Artificial Sequence; identical to SEQ ID NO: 10208
  Pan degenerate oligonucleotide primer
  primer_bind (1)..(31)
  modified_base (1)..(1): base is a locked nucleic acid
  modified_base (2)..(2): base is a locked nucleic acid
  modified_base (5)..(5): base is a locked nucleic acid
  misc_feature (25)..(31): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10211 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 58 to correspond to the nucleotides in an oligonucleotide probe upstream of the discriminating single nucleotide polymorphism.
ggrggaattggaggytttatyaargtaarr

SEQ ID NO: 10212 - DNA, 30 bp, Artificial Sequence; identical to SEQ ID NO: 10211
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10213 - DNA, 30 bp, Artificial Sequence; identical to SEQ ID NO: 10211
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10214 - DNA, 40 bp, Artificial Sequence; identical to SEQ ID NO: 10196
  Pan degenerate oligonucleotide primer
  primer_bind (1)..(40)
  misc_feature (34)..(40): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10215 - DNA, 35 bp, Artificial Sequence; identical to SEQ ID NO: 10199
  Pan degenerate oligonucleotide primer
  primer_bind (1)..(35)
  misc_feature (29)..(35): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10216 - DNA, 33 bp, Artificial Sequence; identical to SEQ ID NO: 10202
  Pan degenerate oligonucleotide primer
  primer_bind (1)..(33)
  misc_feature (27)..(33): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10217 - DNA, 32 bp, Artificial Sequence; identical to SEQ ID NO: 10205
  Pan degenerate oligonucleotide primer
  primer_bind (1)..(32)
  misc_feature (26)..(32): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10218 - DNA, 31 bp, Artificial Sequence; identical to SEQ ID NO: 10208
  Pan degenerate oligonucleotide primer
  primer_bind (1)..(31)
  misc_feature (25)..(31): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10219 - DNA, 30 bp, Artificial Sequence; identical to SEQ ID NO: 10211
  Pan degenerate oligonucleotide primer
  primer_bind (1)..(30)
  misc_feature (24)..(30): Adaptor region of the pan degenerate sense primer that adapts the probe-binding site upstream of codon 58 to correspond to the nucleotides in an oligonucleotide probe upstream of the discriminating single nucleotide polymorphism.

SEQ ID NO: 10220 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 58 to correspond to the nucleotides in an oligonucleotide probe upstream of the discriminating single nucleotide polymorphism.
aarccaaaaatrataggrggaattggaggytttrtyaaagtaaga

SEQ ID NO: 10221 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 58 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aaraatgataggrggaattggaggytttatyaargtaarrn

SEQ ID NO: 10222 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 58 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
tgataggrggaattggaggytttatyaargtaarrn

SEQ ID NO: 10223 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 58 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ataggrggaattggaggytttatyaargtaarrn

SEQ ID NO: 10224 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 58 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
taggrggaattggaggytttatyaargtaarrn

SEQ ID NO: 10225 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 58 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
aggrggaattggaggytttatyaargtaarrn

SEQ ID NO: 10226 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 58 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
ggrggaattggaggytttatyaargtaarrn

SEQ ID NO: 10227 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 58 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aarccaaaaatrataggrggaattggaggytttrtyaaagtaagan

SEQ ID NO: 10228 - DNA, 40 bp, Artificial Sequence
  Pan degenerate oligonucleotide primer
  primer_bind (1)..(40)
  modified_base (3)..(3): base is a locked nucleic acid
  modified_base (5)..(5): base is a locked nucleic acid
  modified_base (6)..(6): base is a locked nucleic acid
  misc_feature (17)..(17): n is a, c, g, or t
  misc_feature (34)..(40): Adaptor region of the pan degenerate sense primer that adapts the probe-binding site upstream of codon 71 to correspond to the nucleotides in an oligonucleotide probe upstream of the discriminating single nucleotide polymorphism.
rcartatgaksarrtanyyatagaaatytgtggrmawarr

SEQ ID NO: 10229 - DNA, 40 bp, Artificial Sequence; identical to SEQ ID NO: 10228
  Pan degenerate oligonucleotide primer
  primer_bind (1)..(40)
  modified_base (3)..(3): base is a locked nucleic acid
  modified_base (6)..(6): base is a locked nucleic acid
  modified_base (8)..(8): base is a locked nucleic acid
  misc_feature (17)..(17): n is a, c, g, or t
  misc_feature (34)..(40): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10230 - DNA, 40 bp, Artificial Sequence; identical to SEQ ID NO: 10228
  Pan degenerate oligonucleotide primer
  primer_bind (1)..(40)
  modified_base (3)..(3): base is a locked nucleic acid
  modified_base (5)..(5): base is a locked nucleic acid
  modified_base (8)..(8): base is a locked nucleic acid
  misc_feature (17)..(17): n is a, c, g, or t
  misc_feature (34)..(40): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10231 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (13)..(13): n is a, c, g, or t
  misc_feature (30)..(36): Adaptor region of the pan degenerate sense primer that adapts the probe-binding site upstream of codon 71 to correspond to the nucleotides in an oligonucleotide probe upstream of the discriminating single nucleotide polymorphism.
tatgaksarrtanyyatagaaatytgtggrmawarr

SEQ ID NO: 10232 - DNA, 36 bp, Artificial Sequence; identical to SEQ ID NO: 10231
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (13)..(13): n is a, c, g, or t
  misc_feature (30)..(36): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10233 - DNA, 36 bp, Artificial Sequence; identical to SEQ ID NO: 10231
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (13)..(13): n is a, c, g, or t
  misc_feature (30)..(36): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10234 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (12)..(12): n is a, c, g, or t
  misc_feature (29)..(35): Adaptor region of the pan degenerate sense primer that adapts the probe-binding site upstream of codon 71 to correspond to the nucleotides in an oligonucleotide probe upstream of the discriminating single nucleotide polymorphism.
atgaksarrtanyyatagaaatytgtggrmawarr

SEQ ID NO: 10235 - DNA, 35 bp, Artificial Sequence; identical to SEQ ID NO: 10234
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (12)..(12): n is a, c, g, or t
  misc_feature (29)..(35): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10236 - DNA, 35 bp, Artificial Sequence; identical to SEQ ID NO: 10234
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (12)..(12): n is a, c, g, or t
  misc_feature (29)..(35): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10237 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (10)..(10): n is a, c, g, or t
  misc_feature (27)..(33): Adaptor region of the pan degenerate sense primer that adapts the probe-binding site upstream of codon 71 to correspond to the nucleotides in an oligonucleotide probe upstream of the discriminating single nucleotide polymorphism.
gaksarrtanyyatagaaatytgtggrmawarr

SEQ ID NO: 10238 - DNA, 33 bp, Artificial Sequence; identical to SEQ ID NO: 10237
  Pan degenerate oligonucleotide primer
  primer_bind (1)..(33)
  modified_base (1)..(1): base is a locked nucleic acid
  modified_base (5)..(5): base is a locked nucleic acid
  modified_base (8)..(8): base is a locked nucleic acid
  misc_feature (10)..(10): n is a, c, g, or t
  misc_feature (27)..(33): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10239 - DNA, 33 bp, Artificial Sequence; identical to SEQ ID NO: 10237
  Pan degenerate oligonucleotide primer
  primer_bind (1)..(33)
  modified_base (1)..(1): base is a locked nucleic acid
  modified_base (2)..(2): base is a locked nucleic acid
  modified_base (8)..(8): base is a locked nucleic acid
  misc_feature (10)..(10): n is a, c, g, or t
  misc_feature (27)..(33): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10240 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (9)..(9): n is a, c, g, or t
  misc_feature (26)..(32): Adaptor region of the pan degenerate sense primer that adapts the probe-binding site upstream of codon 71 to correspond to the nucleotides in an oligonucleotide probe upstream of the discriminating single nucleotide polymorphism.
aksarrtanyyatagaaatytgtggrmawarr

SEQ ID NO: 10241 - DNA, 32 bp, Artificial Sequence; identical to SEQ ID NO: 10240
  Pan degenerate oligonucleotide primer
  primer_bind (1)..(32)
  modified_base (1)..(1): base is a locked nucleic acid
  modified_base (7)..(7): base is a locked nucleic acid
  misc_feature (9)..(9): n is a, c, g, or t
  modified_base (13)..(13): base is a locked nucleic acid
  misc_feature (26)..(32): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10242 - DNA, 32 bp, Artificial Sequence; identical to SEQ ID NO: 10240
  Pan degenerate oligonucleotide primer
  primer_bind (1)..(32)
  modified_base (1)..(1): base is a locked nucleic acid
  modified_base (4)..(4): base is a locked nucleic acid
  misc_feature (9)..(9): n is a, c, g, or t
  modified_base (13)..(13): base is a locked nucleic acid
  misc_feature (26)..(32): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10243 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  misc_feature (6)..(6): n is a, c, g, or t
  modified_base (10)..(10): base is a locked nucleic acid
  misc_feature (23)..(29): Adaptor region of the pan degenerate sense primer that adapts the probe-binding site upstream of codon 71 to correspond to the nucleotides in an oligonucleotide probe upstream of the discriminating single nucleotide polymorphism.
arrtanyyatagaaatytgtggrmawarr

SEQ ID NO: 10244 - DNA, 29 bp, Artificial Sequence
  Pan degenerate oligonucleotide primer
  primer_bind (1)..(29)
  modified_base (1)..(1): base is a locked nucleic acid
  misc_feature (6)..(6): n is a, c, g, or t
  modified_base (10)..(10): base is a locked nucleic acid
  modified_base (12)..(12): base is a locked nucleic acid
  misc_feature (23)..(29): Adaptor region of the pan degenerate sense primer that adapts the probe-binding site upstream of codon 71 to correspond to the nucleotides in an oligonucleotide probe upstream of the discriminating single nucleotide polymorphism.
arrtanyyatagaaatytgtggrmawarr

SEQ ID NO: 10245 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  misc_feature (6)..(6): n is a, c, g, or t
  modified_base (12)..(12): base is a locked nucleic acid
  misc_feature (23)..(29): Adaptor region of the pan degenerate sense primer that adapts the probe-binding site upstream of codon 71 to correspond to the nucleotides in an oligonucleotide probe upstream of the discriminating single nucleotide polymorphism.
arrtanyyatagaaatytgtggrmawarr

SEQ ID NO: 10246 - DNA, 40 bp, Artificial Sequence; identical to SEQ ID NO: 10228
  Pan degenerate oligonucleotide primer
  primer_bind (1)..(40)
  misc_feature (17)..(17): n is a, c, g, or t
  misc_feature (34)..(40): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10247 - DNA, 36 bp, Artificial Sequence; identical to SEQ ID NO: 10231
  Pan degenerate oligonucleotide primer
  primer_bind (1)..(36)
  misc_feature (13)..(13): n is a, c, g, or t
  misc_feature (30)..(36): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10248 - DNA, 35 bp, Artificial Sequence; identical to SEQ ID NO: 10234
  Pan degenerate oligonucleotide primer
  primer_bind (1)..(35)
  misc_feature (12)..(12): n is a, c, g, or t
  misc_feature (29)..(35): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10249 - DNA, 33 bp, Artificial Sequence; identical to SEQ ID NO: 10237
  Pan degenerate oligonucleotide primer
  primer_bind (1)..(33)
  misc_feature (10)..(10): n is a, c, g, or t
  misc_feature (27)..(33): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10250 - DNA, 32 bp, Artificial Sequence; identical to SEQ ID NO: 10240
  Pan degenerate oligonucleotide primer
  primer_bind (1)..(32)
  misc_feature (9)..(9): n is a, c, g, or t
  misc_feature (26)..(32): Adaptor region of the pan degenerate sense primer that adapts the probe-binding site upstream of codon 71 to correspond to the nucleotides in an oligonucleotide probe upstream of the discriminating single nucleotide polymorphism.

SEQ ID NO: 10251 - DNA, 29 bp, Artificial Sequence
  Pan degenerate oligonucleotide primer
  primer_bind (1)..(29)
  misc_feature (6)..(6): n is a, c, g, or t
  misc_feature (23)..(29): Adaptor region of the pan degenerate sense primer that adapts the probe-binding site upstream of codon 71 to correspond to the nucleotides in an oligonucleotide probe upstream of the discriminating single nucleotide polymorphism.
arrtanyyatagaaatytgtggrmawarr

SEQ ID NO: 10252 - DNA, 45 bp, Artificial Sequence
  Pan degenerate oligonucleotide primer
  primer_bind (1)..(45)
  misc_feature (22)..(22): n is a, c, g, or t
  misc_feature (39)..(45): Adaptor region of the pan degenerate sense primer that adapts the probe-binding site upstream of codon 71 to correspond to the nucleotides in an oligonucleotide probe upstream of the discriminating single nucleotide polymorphism.
gtaarrcartatgaksavrtanhhrtagaratytgyggrcataaa

SEQ ID NO: 10253 - DNA, 41 bp, Artificial Sequence
  Pan degenerate oligonucleotide primer
  primer_bind (1)..(41)
  misc_feature (17)..(17): n is a, c, g, or t
  misc_feature (34)..(40): Adaptor region of the pan degenerate sense primer that adapts the probe-binding site upstream of codon 71 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rcartatgaksarrtanyyatagaaatytgtggrmawarrn

SEQ ID NO: 10254 - DNA, 37 bp, Artificial Sequence
  Pan degenerate oligonucleotide primer
  primer_bind (1)..(37)
  misc_feature (13)..(13): n is a, c, g, or t
  misc_feature (30)..(36): Adaptor region of the pan degenerate sense primer that adapts the probe-binding site upstream of codon 71 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
tatgaksarrtanyyatagaaatytgtggrmawarrn

SEQ ID NO: 10255 - DNA, 36 bp, Artificial Sequence
  Pan degenerate oligonucleotide primer
  primer_bind (1)..(36)
  misc_feature (12)..(12): n is a, c, g, or t
  misc_feature (29)..(35): Adaptor region of the pan degenerate sense primer that adapts the probe-binding site upstream of codon 71 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
atgaksarrtanyyatagaaatytgtggrmawarrn

SEQ ID NO: 10256 - DNA, 34 bp, Artificial Sequence
  Pan degenerate oligonucleotide primer
  primer_bind (1)..(34)
  misc_feature (10)..(10): n is a, c, g, or t
  misc_feature (27)..(33): Adaptor region of the pan degenerate sense primer that adapts the probe-binding site upstream of codon 71 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
gaksarrtanyyatagaaatytgtggrmawarrn

SEQ ID NO: 10257 - DNA, 33 bp, Artificial Sequence
  Pan degenerate oligonucleotide primer
  primer_bind (1)..(33)
  misc_feature (9)..(9): n is a, c, g, or t
  misc_feature (26)..(32): Adaptor region of the pan degenerate sense primer that adapts the probe-binding site upstream of codon 71 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
aksarrtanyyatagaaatytgtggrmawarrn

SEQ ID NO: 10258 - DNA, 30 bp, Artificial Sequence
  Pan degenerate oligonucleotide primer
  primer_bind (1)..(30)
  misc_feature (6)..(6): n is a, c, g, or t
  misc_feature (23)..(29): Adaptor region of the pan degenerate sense primer that adapts the probe-binding site upstream of codon 71 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
arrtanyyatagaaatytgtggrmawarrn

SEQ ID NO: 10259 - DNA, 46 bp, Artificial Sequence
  Pan degenerate oligonucleotide primer
  primer_bind (1)..(46)
  misc_feature (22)..(22): n is a, c, g, or t
  misc_feature (39)..(45): Adaptor region of the pan degenerate sense primer that adapts the probe-binding site upstream of codon 71 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gtaarrcartatgaksavrtanhhrtagaratytgyggrcataaan

SEQ ID NO: 10260 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (10)..(10): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.
gaksarrtanyyatagaaatytgtggrmawarrgcyatag

SEQ ID NO: 10261 - DNA, 40 bp, Artificial Sequence; identical to SEQ ID NO: 10260
  Pan degenerate oligonucleotide primer
  primer_bind (1)..(40)
  modified_base (1)..(1): base is a locked nucleic acid
  modified_base (5)..(5): base is a locked nucleic acid
  modified_base (8)..(8): base is a locked nucleic acid
  misc_feature (10)..(10): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10262 - DNA, 40 bp, Artificial Sequence; identical to SEQ ID NO: 10260
  Pan degenerate oligonucleotide primer
  primer_bind (1)..(40)
  modified_base (1)..(1): base is a locked nucleic acid
  modified_base (2)..(2): base is a locked nucleic acid
  modified_base (8)..(8): base is a locked nucleic acid
  misc_feature (10)..(10): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10263 - DNA, 39 bp, Artificial Sequence
  Pan degenerate oligonucleotide primer
  primer_bind (1)..(39)
  modified_base (1)..(1): base is a locked nucleic acid
  modified_base (4)..(4): base is a locked nucleic acid
  modified_base (7)..(7): base is a locked nucleic acid
  misc_feature (9)..(9): n is a, c, g, or t
  misc_feature (33)..(39): Adaptor region of the pan degenerate sense primer that adapts the probe-binding site upstream of codon 73 to correspond to the nucleotides in an oligonucleotide probe upstream of the discriminating single nucleotide polymorphism.
aksarrtanyyatagaaatytgtggrmawarrgcyatag

SEQ ID NO: 10264 - DNA, 39 bp, Artificial Sequence; identical to SEQ ID NO: 10263
  Pan degenerate oligonucleotide primer
  primer_bind (1)..(39)
  modified_base (1)..(1): base is a locked nucleic acid
  modified_base (7)..(7): base is a locked nucleic acid
  misc_feature (9)..(9): n is a, c, g, or t
  modified_base (13)..(13): base is a locked nucleic acid
  misc_feature (33)..(39): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10265 - DNA, 39 bp, Artificial Sequence; identical to SEQ ID NO: 10263
  Pan degenerate oligonucleotide primer
  primer_bind (1)..(39)
  modified_base (1)..(1): base is a locked nucleic acid
  modified_base (4)..(4): base is a locked nucleic acid
  misc_feature (9)..(9): n is a, c, g, or t
  modified_base (13)..(13): base is a locked nucleic acid
  misc_feature (33)..(39): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10266 - DNA, 36 bp, Artificial Sequence
  Pan degenerate oligonucleotide primer
  primer_bind (1)..(36)
  modified_base (1)..(1): base is a locked nucleic acid
  modified_base (4)..(4): base is a locked nucleic acid
  misc_feature (6)..(6): n is a, c, g, or t
  modified_base (10)..(10): base is a locked nucleic acid
  misc_feature (30)..(36): Adaptor region of the pan degenerate sense primer that adapts the probe-binding site upstream of codon 73 to correspond to the nucleotides in an oligonucleotide probe upstream of the discriminating single nucleotide polymorphism.
arrtanyyatagaaatytgtggrmawarrgcyatag

SEQ ID NO: 10267 - DNA, 36 bp, Artificial Sequence; identical to SEQ ID NO: 10266
  Pan degenerate oligonucleotide primer
  primer_bind (1)..(36)
  modified_base (1)..(1): base is a locked nucleic acid
  misc_feature (6)..(6): n is a, c, g, or t
  modified_base (10)..(10): base is a locked nucleic acid
  modified_base (12)..(12): base is a locked nucleic acid
  misc_feature (30)..(36): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10268 - DNA, 36 bp, Artificial Sequence; identical to SEQ ID NO: 10266
  Pan degenerate oligonucleotide primer
  primer_bind (1)..(36)
  modified_base (1)..(1): base is a locked nucleic acid
  modified_base (4)..(4): base is a locked nucleic acid
  misc_feature (6)..(6): n is a, c, g, or t
  modified_base (12)..(12): base is a locked nucleic acid
  misc_feature (30)..(36): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10269 - DNA, 33 bp, Artificial Sequence
  Pan degenerate oligonucleotide primer
  primer_bind (1)..(33)
  modified_base (1)..(1): base is a locked nucleic acid
  misc_feature (3)..(3): n is a, c, g, or t
  modified_base (7)..(7): base is a locked nucleic acid
  modified_base (9)..(9): base is a locked nucleic acid
  misc_feature (27)..(33): Adaptor region of the pan degenerate sense primer that adapts the probe-binding site upstream of codon 73 to correspond to the nucleotides in an oligonucleotide probe upstream of the discriminating single nucleotide polymorphism.
tanyyatagaaatytgtggrmawarrgcyatag

SEQ ID NO: 10270 - DNA, 33 bp, Artificial Sequence; identical to SEQ ID NO: 10269
  Pan degenerate oligonucleotide primer
  primer_bind (1)..(33)
  modified_base (1)..(1): base is a locked nucleic acid
  misc_feature (3)..(3): n is a, c, g, or t
  modified_base (9)..(9): base is a locked nucleic acid
  modified_base (10)..(10): base is a locked nucleic acid
  misc_feature (27)..(33): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10271 - DNA, 33 bp, Artificial Sequence; identical to SEQ ID NO: 10269
  Pan degenerate oligonucleotide primer
  primer_bind (1)..(33)
  modified_base (1)..(1): base is a locked nucleic acid
  misc_feature (3)..(3): n is a, c, g, or t
  modified_base (7)..(7): base is a locked nucleic acid
  modified_base (10)..(10): base is a locked nucleic acid
  misc_feature (27)..(33): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10272 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (4)..(4): base is a locked nucleic acid
  misc_feature (21)..(27): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyatag

SEQ ID NO: 10273 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (7)..(7): base is a locked nucleic acid
  misc_feature (21)..(27): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyatag

SEQ ID NO: 10274 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (7)..(7): base is a locked nucleic acid
  misc_feature (21)..(27): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyatag

SEQ ID NO: 10275 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (5)..(5): base is a locked nucleic acid
  misc_feature (19)..(25): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyatag

SEQ ID NO: 10276 - DNA, 25 bp, Artificial Sequence
  Pan degenerate oligonucleotide primer
  primer_bind (1)..(25)
  modified_base (1)..(1): base is a locked nucleic acid
  modified_base (5)..(5): base is a locked nucleic acid
  modified_base (10)..(10): base is a locked nucleic acid
  misc_feature (19)..(25): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyatag

SEQ ID NO: 10277 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (10)..(10): base is a locked nucleic acid
  misc_feature (19)..(25): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyatag

SEQ ID NO: 10278 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (11)..(11): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.
tgaksarrtanyyatagaaatytgtggrmawarrgcyata

SEQ ID NO: 10279 - DNA, 40 bp, Artificial Sequence; identical to SEQ ID NO: 10278
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (11)..(11): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10280 - DNA, 40 bp, Artificial Sequence; identical to SEQ ID NO: 10278
  Pan degenerate oligonucleotide primer
  primer_bind (1)..(40)
  modified_base (2)..(2): base is a locked nucleic acid
  modified_base (3)..(3): base is a locked nucleic acid
  modified_base (9)..(9): base is a locked nucleic acid
  misc_feature (11)..(11): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10281 - DNA, 38 bp, Artificial Sequence
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (9)..(9): n is a, c, g, or t
  misc_feature (32)..(38): Adaptor region of the pan degenerate sense primer that adapts the probe-binding site upstream of codon 73 to correspond to the nucleotides in an oligonucleotide probe upstream of the discriminating single nucleotide polymorphism.
aksarrtanyyatagaaatytgtggrmawarrgcyata

SEQ ID NO: 10282 - DNA, 38 bp, Artificial Sequence; identical to SEQ ID NO: 10281
  Pan degenerate oligonucleotide primer
  primer_bind (1)..(38)
  modified_base (1)..(1): base is a locked nucleic acid
  modified_base (7)..(7): base is a locked nucleic acid
  misc_feature (9)..(9): n is a, c, g, or t
  modified_base (13)..(13): base is a locked nucleic acid
  misc_feature (32)..(38): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10283 - DNA, 38 bp, Artificial Sequence; identical to SEQ ID NO: 10281
  Pan degenerate oligonucleotide primer
  primer_bind (1)..(38)
  modified_base (1)..(1): base is a locked nucleic acid
  modified_base (4)..(4): base is a locked nucleic acid
  misc_feature (9)..(9): n is a, c, g, or t
  modified_base (13)..(13): base is a locked nucleic acid
  misc_feature (32)..(38): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10284 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  misc_feature (6)..(6): n is a, c, g, or t
  modified_base (10)..(10): base is a locked nucleic acid
  misc_feature (29)..(35): Adaptor region of the pan degenerate sense primer that adapts the probe-binding site upstream of codon 73 to correspond to the nucleotides in an oligonucleotide probe upstream of the discriminating single nucleotide polymorphism.
arrtanyyatagaaatytgtggrmawarrgcyata

SEQ ID NO: 10285 - DNA, 35 bp, Artificial Sequence; identical to SEQ ID NO: 10284
  Pan degenerate oligonucleotide primer
  primer_bind (1)..(35)
  modified_base (1)..(1): base is a locked nucleic acid
  misc_feature (6)..(6): n is a, c, g, or t
  modified_base (10)..(10): base is a locked nucleic acid
  modified_base (12)..(12): base is a locked nucleic acid
  misc_feature (29)..(35): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10286 - DNA, 35 bp, Artificial Sequence; identical to SEQ ID NO: 10284
  Pan degenerate oligonucleotide primer
  primer_bind (1)..(35)
  modified_base (1)..(1): base is a locked nucleic acid
  modified_base (4)..(4): base is a locked nucleic acid
  misc_feature (6)..(6): n is a, c, g, or t
  modified_base (12)..(12): base is a locked nucleic acid
  misc_feature (29)..(35): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10287 - DNA, 32 bp, Artificial Sequence
  Pan degenerate oligonucleotide primer
  primer_bind (1)..(32)
  modified_base (1)..(1): base is a locked nucleic acid
  misc_feature (3)..(3): n is a, c, g, or t
  modified_base (7)..(7): base is a locked nucleic acid
  modified_base (9)..(9): base is a locked nucleic acid
  misc_feature (26)..(32): Adaptor region of the pan degenerate sense primer that adapts the probe-binding site upstream of codon 73 to correspond to the nucleotides in an oligonucleotide probe upstream of the discriminating single nucleotide polymorphism.
tanyyatagaaatytgtggrmawarrgcyata

SEQ ID NO: 10288 - DNA, 32 bp, Artificial Sequence; identical to SEQ ID NO: 10287
  Pan degenerate oligonucleotide primer
  primer_bind (1)..(32)
  modified_base (1)..(1): base is a locked nucleic acid
  misc_feature (3)..(3): n is a, c, g, or t
  modified_base (9)..(9): base is a locked nucleic acid
  modified_base (10)..(10): base is a locked nucleic acid
  misc_feature (26)..(32): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10289 - DNA, 32 bp, Artificial Sequence; identical to SEQ ID NO: 10287
  Pan degenerate oligonucleotide primer
  primer_bind (1)..(32)
  modified_base (1)..(1): base is a locked nucleic acid
  misc_feature (3)..(3): n is a, c, g, or t
  modified_base (7)..(7): base is a locked nucleic acid
  modified_base (10)..(10): base is a locked nucleic acid
  misc_feature (26)..(32): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10290 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyata

SEQ ID NO: 10291 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (7)..(7): base is a locked nucleic acid
  misc_feature (20)..(26): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyata

SEQ ID NO: 10292 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (7)..(7): base is a locked nucleic acid
  misc_feature (20)..(26): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyata

SEQ ID NO: 10293 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (5)..(5): base is a locked nucleic acid
  misc_feature (18)..(24): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyata

SEQ ID NO: 10294 - DNA, 24 bp, Artificial Sequence
  Pan degenerate oligonucleotide primer
  primer_bind (1)..(24)
  modified_base (1)..(1): base is a locked nucleic acid
  modified_base (5)..(5): base is a locked nucleic acid
  modified_base (10)..(10): base is a locked nucleic acid
  misc_feature (18)..(24): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyata

SEQ ID NO: 10295 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (10)..(10): base is a locked nucleic acid
  misc_feature (18)..(24): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyata

SEQ ID NO: 10296 - DNA, 40 bp, Artificial Sequence; identical to SEQ ID NO: 10260
  Pan degenerate oligonucleotide primer
  primer_bind (1)..(40)
  misc_feature (10)..(10): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10297 - DNA, 39 bp, Artificial Sequence; identical to SEQ ID NO: 10263
  Pan degenerate oligonucleotide primer
  primer_bind (1)..(39)
  misc_feature (9)..(9): n is a, c, g, or t
  misc_feature (33)..(39): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10298 - DNA, 36 bp, Artificial Sequence; identical to SEQ ID NO: 10266
  Pan degenerate oligonucleotide primer
  primer_bind (1)..(36)
  misc_feature (6)..(6): n is a, c, g, or t
  misc_feature (30)..(36): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10299 - DNA, 33 bp, Artificial Sequence; identical to SEQ ID NO: 10269
  Pan degenerate oligonucleotide primer
  primer_bind (1)..(33)
  misc_feature (3)..(3): n is a, c, g, or t
  misc_feature (27)..(33): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10300 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyatag

SEQ ID NO: 10301 - DNA, 25 bp, Artificial Sequence
  Pan degenerate oligonucleotide primer
  primer_bind (1)..(25)
  misc_feature (19)..(25): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyatag

SEQ ID NO: 10302 - DNA, 40 bp, Artificial Sequence; identical to SEQ ID NO: 10278
  Pan degenerate oligonucleotide primer
  primer_bind (1)..(40)
  misc_feature (11)..(11): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10303 - DNA, 38 bp, Artificial Sequence; identical to SEQ ID NO: 10281
  Pan degenerate oligonucleotide primer
  primer_bind (1)..(38)
  misc_feature (9)..(9): n is a, c, g, or t
  misc_feature (32)..(38): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10304 - DNA, 35 bp, Artificial Sequence; identical to SEQ ID NO: 10284
  Pan degenerate oligonucleotide primer
  primer_bind (1)..(35)
  misc_feature (6)..(6): n is a, c, g, or t
  misc_feature (29)..(35): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10305 - DNA, 32 bp, Artificial Sequence; identical to SEQ ID NO: 10287
  Pan degenerate oligonucleotide primer
  primer_bind (1)..(32)
  misc_feature (3)..(3): n is a, c, g, or t
  misc_feature (26)..(32): Adaptor region of the pan degenerate sense primer that adapts the probe-binding site upstream of codon 73 to correspond to the nucleotides in an oligonucleotide probe upstream of the discriminating single nucleotide polymorphism.

SEQ ID NO: 10306 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 73 to correspond to the nucleotides in an oligonucleotide probe upstream of the discriminating single nucleotide polymorphism.
tagaaatytgtggrmawarrgcyata

SEQ ID NO: 10307 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 73 to correspond to the nucleotides in an oligonucleotide probe upstream of the discriminating single nucleotide polymorphism.
gaaatytgtggrmawarrgcyata

SEQ ID NO: 10308 - DNA, 45 bp, Artificial Sequence
  Pan degenerate oligonucleotide primer
  primer_bind (1)..(45)
  misc_feature (16)..(16): n is a, c, g, or t
  misc_feature (39)..(45): Adaptor region of the pan degenerate sense primer that adapts the probe-binding site upstream of codon 73 to correspond to the nucleotides in an oligonucleotide probe upstream of the discriminating single nucleotide polymorphism.
cartatgaksavrtanhhrtagaratytgyggrmaharrgctata

SEQ ID NO: 10309 - DNA, 41 bp, Artificial Sequence
  Pan degenerate oligonucleotide primer
  primer_bind (1)..(41)
  misc_feature (10)..(10): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gaksarrtanyyatagaaatytgtggrmawarrgcyatagn

SEQ ID NO: 10310 - DNA, 40 bp, Artificial Sequence
  Pan degenerate oligonucleotide primer
  primer_bind (1)..(40)
  misc_feature (9)..(9): n is a, c, g, or t
  misc_feature (33)..(39): Adaptor region of the pan degenerate sense primer that adapts the probe-binding site upstream of codon 73 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
aksarrtanyyatagaaatytgtggrmawarrgcyatagn

SEQ ID NO: 10311 - DNA, 37 bp, Artificial Sequence
  Pan degenerate oligonucleotide primer
  primer_bind (1)..(37)
  misc_feature (6)..(6): n is a, c, g, or t
  misc_feature (30)..(36): Adaptor region of the pan degenerate sense primer that adapts the probe-binding site upstream of codon 73 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
arrtanyyatagaaatytgtggrmawarrgcyatagn

SEQ ID NO: 10312 - DNA, 34 bp, Artificial Sequence
  Pan degenerate oligonucleotide primer
  primer_bind (1)..(34)
  misc_feature (3)..(3): n is a, c, g, or t
  misc_feature (27)..(33): Adaptor region of the pan degenerate sense primer that adapts the probe-binding site upstream of codon 73 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tanyyatagaaatytgtggrmawarrgcyatagn

SEQ ID NO: 10313 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 73 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
tagaaatytgtggrmawarrgcyatagn

SEQ ID NO: 10314 - DNA, 26 bp, Artificial Sequence
  Pan degenerate oligonucleotide primer
  primer_bind (1)..(26)
  misc_feature (19)..(25): Adaptor region of the pan degenerate sense primer that adapts the probe-binding site upstream of codon 73 to correspond to the nucleotides in an oligonucleotide probe upstream of the discriminating single nucleotide polymorphism.
  modified_base (26)..(26): base is a locked nucleic acid
  misc_feature (26)..(26): n is a, c, g, or t
gaaatytgtggrmawarrgcyatagn

SEQ ID NO: 10315 - DNA, 41 bp, Artificial Sequence
  Pan degenerate oligonucleotide primer
  primer_bind (1)..(41)
  misc_feature (11)..(11): n is a, c, g, or t
  misc_feature (34)..(40): Adaptor region of the pan degenerate sense primer that adapts the probe-binding site upstream of codon 73 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
tgaksarrtanyyatagaaatytgtggrmawarrgcyatan

SEQ ID NO: 10316 - DNA, 39 bp, Artificial Sequence
  Pan degenerate oligonucleotide primer
  primer_bind (1)..(39)
  misc_feature (9)..(9): n is a, c, g, or t
  misc_feature (32)..(38): Adaptor region of the pan degenerate sense primer that adapts the probe-binding site upstream of codon 73 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
aksarrtanyyatagaaatytgtggrmawarrgcyatan

SEQ ID NO: 10317 - DNA, 36 bp, Artificial Sequence
  Pan degenerate oligonucleotide primer
  primer_bind (1)..(36)
  misc_feature (6)..(6): n is a, c, g, or t
  misc_feature (29)..(35): Adaptor region of the pan degenerate sense primer that adapts the probe-binding site upstream of codon 73 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
arrtanyyatagaaatytgtggrmawarrgcyatan

SEQ ID NO: 10318 - DNA, 33 bp, Artificial Sequence
  Pan degenerate oligonucleotide primer
  primer_bind (1)..(33)
  misc_feature (3)..(3): n is a, c, g, or t
  misc_feature (26)..(32): Adaptor region of the pan degenerate sense primer that adapts the probe-binding site upstream of codon 73 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
tanyyatagaaatytgtggrmawarrgcyatan

SEQ ID NO: 10319 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 73 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
tagaaatytgtggrmawarrgcyatan

SEQ ID NO: 10320 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 73 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
gaaatytgtggrmawarrgcyatan

SEQ ID NO: 10321 - DNA, 46 bp, Artificial Sequence
  Pan degenerate oligonucleotide primer
  primer_bind (1)..(46)
  misc_feature (16)..(16): n is a, c, g, or t
  misc_feature (39)..(45): Adaptor region of the pan degenerate sense primer that adapts the probe-binding site upstream of codon 73 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
cartatgaksavrtanhhrtagaratytgyggrmaharrgctatan

SEQ ID NO: 10322 - DNA, 40 bp, Artificial Sequence
  Pan degenerate oligonucleotide primer
  primer_bind (1)..(40)
  modified_base (3)..(3): base is a locked nucleic acid
  modified_base (6)..(6): base is a locked nucleic acid
  misc_feature (8)..(8): n is a, c, g, or t
  modified_base (12)..(12): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.
ksarrtanyyatagaaatytgtggrmawarrgcyataggk

SEQ ID NO: 10323 - DNA, 40 bp, Artificial Sequence; identical to SEQ ID NO: 10322
  Pan degenerate oligonucleotide primer
  primer_bind (1)..(40)
  modified_base (3)..(3): base is a locked nucleic acid
  misc_feature (8)..(8): n is a, c, g, or t
  modified_base (12)..(12): base is a locked nucleic acid
  modified_base (14)..(14): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 10324 - DNA, 40 bp, Artificial Sequence; identical to SEQ ID NO: 10322
  Pan degenerate oligonucleotide primer
  primer_bind (1)..(40)
  modified_base (3)..(3): base is a locked nucleic acid
  modified_base (6)..(6): base is a locked nucleic acid
  misc_feature (8)..(8): n is a, c, g, or t
  modified_base (14)..(14): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 10325 - DNA, 35 bp, Artificial Sequence
  Pan degenerate oligonucleotide primer
  primer_bind (1)..(35)
  modified_base (1)..(1): base is a locked nucleic acid
  misc_feature (3)..(3): n is a, c, g, or t
  modified_base (7)..(7): base is a locked nucleic acid
  modified_base (9)..(9): base is a locked nucleic acid
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.
tanyyatagaaatytgtggrmawarrgcyataggk

SEQ ID NO: 10326 - DNA, 35 bp, Artificial Sequence; identical to SEQ ID NO: 10325
  Pan degenerate oligonucleotide primer
  primer_bind (1)..(35)
  modified_base (1)..(1): base is a locked nucleic acid
  misc_feature (3)..(3): n is a, c, g, or t
  modified_base (9)..(9): base is a locked nucleic acid
  modified_base (10)..(10): base is a locked nucleic acid
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 10327 - DNA, 35 bp, Artificial Sequence; identical to SEQ ID NO: 10325
  Pan degenerate oligonucleotide primer
  primer_bind (1)..(35)
  modified_base (1)..(1): base is a locked nucleic acid
  misc_feature (3)..(3): n is a, c, g, or t
  modified_base (7)..(7): base is a locked nucleic acid
  modified_base (10)..(10): base is a locked nucleic acid
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 10328 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 74 to correspond to the nucleotides in an oligonucleotide probe upstream of the discriminating single nucleotide polymorphism.
tagaaatytgtggrmawarrgcyataggk

SEQ ID NO: 10329 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate sense primer that adapts the probe-binding site upstream of codon 74 to correspond to the nucleotides in an oligonucleotide probe upstream of the discriminating single nucleotide polymorphism.
tagaaatytgtggrmawarrgcyataggk

SEQ ID NO: 10330 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (7)..(7): base is a locked nucleic acid
  misc_feature (23)..(29): Adaptor region of the pan degenerate sense primer that adapts the probe-binding site upstream of codon 74 to correspond to the nucleotides in an oligonucleotide probe upstream of the discriminating single nucleotide polymorphism.
tagaaatytgtggrmawarrgcyataggk

SEQ ID NO: 10331 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate sense primer that adapts the probe-binding site upstream of codon 74 to correspond to the nucleotides in an oligonucleotide probe upstream of the discriminating single nucleotide polymorphism.
gaaatytgtggrmawarrgcyataggk

SEQ ID NO: 10332 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (10)..(10): base is a locked nucleic acid
  misc_feature (21)..(27): Adaptor region of the pan degenerate sense primer that adapts the probe-binding site upstream of codon 74 to correspond to the nucleotides in an oligonucleotide probe upstream of the discriminating single nucleotide polymorphism.
gaaatytgtggrmawarrgcyataggk

SEQ ID NO: 10333 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (10)..(10): base is a locked nucleic acid
  misc_feature (21)..(27): Adaptor region of the pan degenerate sense primer that adapts the probe-binding site upstream of codon 74 to correspond to the nucleotides in an oligonucleotide probe upstream of the discriminating single nucleotide polymorphism.
gaaatytgtggrmawarrgcyataggk

SEQ ID NO: 10334 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (9)..(9): base is a locked nucleic acid
  misc_feature (20)..(26): Adaptor region of the pan degenerate sense primer that adapts the probe-binding site upstream of codon 74 to correspond to the nucleotides in an oligonucleotide probe upstream of the discriminating single nucleotide polymorphism.
aaatytgtggrmawarrgcyataggk

SEQ ID NO: 10335 - DNA, 26 bp, Artificial Sequence
  Pan degenerate oligonucleotide primer
  primer_bind (1)..(26)
  modified_base (1)..(1): base is a locked nucleic acid
  modified_base (9)..(9): base is a locked nucleic acid
  misc_feature (20)..(26): Adaptor region of the pan degenerate sense primer that adapts the probe-binding site upstream of codon 74 to correspond to the nucleotides in an oligonucleotide probe upstream of the discriminating single nucleotide polymorphism.
  modified_base (25)..(25): base is a locked nucleic acid
aaatytgtggrmawarrgcyataggk

SEQ ID NO: 10336 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  misc_feature (20)..(26): Adaptor region of the pan degenerate sense primer that adapts the probe-binding site upstream of codon 74 to correspond to the nucleotides in an oligonucleotide probe upstream of the discriminating single nucleotide polymorphism.
  modified_base (25)..(25): base is a locked nucleic acid
aaatytgtggrmawarrgcyataggk

SEQ ID NO: 10337 - DNA, 23 bp, Artificial Sequence
  Pan degenerate oligonucleotide primer
  primer_bind (1)..(23)
  modified_base (1)..(1): base is a locked nucleic acid
  modified_base (6)..(6): base is a locked nucleic acid
  misc_feature (17)..(23): Adaptor region of the pan degenerate sense primer that adapts the probe-binding site upstream of codon 74 to correspond to the nucleotides in an oligonucleotide probe upstream of the discriminating single nucleotide polymorphism.
  modified_base (22)..(22): base is a locked nucleic acid
tytgtggrmawarrgcyataggk

SEQ ID NO: 10338 - DNA, 23 bp, Artificial Sequence
  Pan degenerate oligonucleotide primer
  primer_bind (1)..(23)
  modified_base (1)..(1): base is a locked nucleic acid
  misc_feature (17)..(23): Adaptor region of the pan degenerate sense primer that adapts the probe-binding site upstream of codon 74 to correspond to the nucleotides in an oligonucleotide probe upstream of the discriminating single nucleotide polymorphism.
  modified_base (22)..(22): base is a locked nucleic acid
tytgtggrmawarrgcyataggk

SEQ ID NO: 10339 - DNA, 23 bp, Artificial Sequence
  Pan degenerate oligonucleotide primer
  primer_bind (1)..(23)
  modified_base (1)..(1): base is a locked nucleic acid
  modified_base (6)..(6): base is a locked nucleic acid
  misc_feature (17)..(23): Adaptor region of the pan degenerate sense primer that adapts the probe-binding site upstream of codon 74 to correspond to the nucleotides in an oligonucleotide probe upstream of the discriminating single nucleotide polymorphism.
tytgtggrmawarrgcyataggk

SEQ ID NO: 10340 - DNA, 40 bp, Artificial Sequence; identical to SEQ ID NO: 10322
  Pan degenerate oligonucleotide primer
  primer_bind (1)..(40)
  misc_feature (8)..(8): n is a, c, g, or t
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 10341 - DNA, 35 bp, Artificial Sequence; identical to SEQ ID NO: 10325
  Pan degenerate oligonucleotide primer
  primer_bind (1)..(35)
  misc_feature (3)..(3): n is a, c, g, or t
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 10342 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 74 to correspond to the nucleotides in an oligonucleotide probe upstream of the discriminating single nucleotide polymorphism.
tagaaatytgtggrmawarrgcyataggk

SEQ ID NO: 10343 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 74 to correspond to the nucleotides in an oligonucleotide probe upstream of the discriminating single nucleotide polymorphism.
gaaatytgtggrmawarrgcyataggk

SEQ ID NO: 10344 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 74 to correspond to the nucleotides in an oligonucleotide probe upstream of the discriminating single nucleotide polymorphism.
aaatytgtggrmawarrgcyataggk

SEQ ID NO: 10345 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 74 to correspond to the nucleotides in an oligonucleotide probe upstream of the discriminating single nucleotide polymorphism.
tytgtggrmawarrgcyataggk

SEQ ID NO: 10346 - DNA, 45 bp, Artificial Sequence
  Pan degenerate oligonucleotide primer
  primer_bind (1)..(45)
  misc_feature (13)..(13): n is a, c, g, or t
  misc_feature (39)..(45): Adaptor region of the pan degenerate sense primer that adapts the probe-binding site upstream of codon 74 to correspond to the nucleotides in an oligonucleotide probe upstream of the discriminating single nucleotide polymorphism.
tatgaksavrtanhhrtagaratytgyggrmaharrryyataggt

SEQ ID NO: 10347 - DNA, 41 bp, Artificial Sequence
  Pan degenerate oligonucleotide primer
  primer_bind (1)..(41)
  misc_feature (8)..(8): n is a, c, g, or t
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ksarrtanyyatagaaatytgtggrmawarrgcyataggkn

SEQ ID NO: 10348 - DNA, 36 bp, Artificial Sequence
  Pan degenerate oligonucleotide primer
  primer_bind (1)..(36)
  misc_feature (3)..(3): n is a, c, g, or t
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
tanyyatagaaatytgtggrmawarrgcyataggkn

SEQ ID NO: 10349 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 74 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
tagaaatytgtggrmawarrgcyataggkn

SEQ ID NO: 10350 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 74 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
gaaatytgtggrmawarrgcyataggkn

SEQ ID NO: 10351 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 74 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
aaatytgtggrmawarrgcyataggkn

SEQ ID NO: 10352 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 74 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
tytgtggrmawarrgcyataggkn

SEQ ID NO: 10353 - DNA, 46 bp, Artificial Sequence
  Pan degenerate oligonucleotide primer
  primer_bind (1)..(46)
  misc_feature (13)..(13): n is a, c, g, or t
  misc_feature (39)..(45): Adaptor region of the pan degenerate sense primer that adapts the probe-binding site upstream of codon 74 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
tatgaksavrtanhhrtagaratytgyggrmaharrryyataggtn

SEQ ID NO: 10354 - DNA, 40 bp, Artificial Sequence
  Pan degenerate oligonucleotide primer
  primer_bind (1)..(40)
  misc_feature (2)..(2): n is a, c, g, or t
  modified_base (6)..(6): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 76 to correspond to the nucleotides in an oligonucleotide probe upstream of the discriminating single nucleotide polymorphism.
anyyatagaaatytgtggrmawarrgcyataggkwcagtr

SEQ ID NO: 10355 - DNA, 40 bp, Artificial Sequence; identical to SEQ ID NO: 10354
  Pan degenerate oligonucleotide primer
  primer_bind (1)..(40)
  misc_feature (2)..(2): n is a, c, g, or t
  modified_base (6)..(6): base is a locked nucleic acid
  modified_base (9)..(9): base is a locked nucleic acid
  modified_base (12)..(12): base is a locked nucleic acid
  misc_feature (34)..(40): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10356 - DNA, 40 bp, Artificial Sequence; identical to SEQ ID NO: 10354
  Pan degenerate oligonucleotide primer
  primer_bind (1)..(40)
  misc_feature (2)..(2): n is a, c, g, or t
  modified_base (6)..(6): base is a locked nucleic acid
  modified_base (8)..(8): base is a locked nucleic acid
  modified_base (12)..(12): base is a locked nucleic acid
  misc_feature (34)..(40): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10357 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 76 to correspond to the nucleotides in an oligonucleotide probe upstream of the discriminating single nucleotide polymorphism.
gaaatytgtggrmawarrgcyataggkwcagtr

SEQ ID NO: 10358 - DNA, 33 bp, Artificial Sequence; identical to SEQ ID NO: 10357
  Pan degenerate oligonucleotide primer
  primer_bind (1)..(33)
  modified_base (1)..(1): base is a locked nucleic acid
  modified_base (5)..(5): base is a locked nucleic acid
  modified_base (10)..(10): base is a locked nucleic acid
  misc_feature (27)..(33): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10359 - DNA, 33 bp, Artificial Sequence; identical to SEQ ID NO: 10357
  Pan degenerate oligonucleotide primer
  primer_bind (1)..(33)
  modified_base (1)..(1): base is a locked nucleic acid
  modified_base (2)..(2): base is a locked nucleic acid
  modified_base (10)..(10): base is a locked nucleic acid
  misc_feature (27)..(33): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10360 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (9)..(9): base is a locked nucleic acid
  misc_feature (26)..(32): Adaptor region of the pan degenerate sense primer that adapts the probe-binding site upstream of codon 76 to correspond to the nucleotides in an oligonucleotide probe upstream of the discriminating single nucleotide polymorphism.
aaatytgtggrmawarrgcyataggkwcagtr

SEQ ID NO: 10361 - DNA, 32 bp, Artificial Sequence; identical to SEQ ID NO: 10360
  Pan degenerate oligonucleotide primer
  primer_bind (1)..(32)
  modified_base (1)..(1): base is a locked nucleic acid
  modified_base (9)..(9): base is a locked nucleic acid
  modified_base (25)..(25): base is a locked nucleic acid
  misc_feature (26)..(32): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10362 - DNA, 32 bp, Artificial Sequence; identical to SEQ ID NO: 10360
  Pan degenerate oligonucleotide primer
  primer_bind (1)..(32)
  modified_base (1)..(1): base is a locked nucleic acid
  modified_base (4)..(4): base is a locked nucleic acid
  modified_base (25)..(25): base is a locked nucleic acid
  misc_feature (26)..(32): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10363 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (22)..(22): base is a locked nucleic acid
  misc_feature (23)..(29): Adaptor region of the pan degenerate sense primer that adapts the probe-binding site upstream of codon 76 to correspond to the nucleotides in an oligonucleotide probe upstream of the discriminating single nucleotide polymorphism.
tytgtggrmawarrgcyataggkwcagtr

SEQ ID NO: 10364 - DNA, 29 bp, Artificial Sequence
  Pan degenerate oligonucleotide primer
  primer_bind (1)..(29)
  modified_base (1)..(1): base is a locked nucleic acid
  modified_base (22)..(22): base is a locked nucleic acid
  misc_feature (23)..(29): Adaptor region of the pan degenerate sense primer that adapts the probe-binding site upstream of codon 76 to correspond to the nucleotides in an oligonucleotide probe upstream of the discriminating single nucleotide polymorphism.
  modified_base (25)..(25): base is a locked nucleic acid
tytgtggrmawarrgcyataggkwcagtr

SEQ ID NO: 10365 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  misc_feature (23)..(29): Adaptor region of the pan degenerate sense primer that adapts the probe-binding site upstream of codon 76 to correspond to the nucleotides in an oligonucleotide probe upstream of the discriminating single nucleotide polymorphism.
  modified_base (25)..(25): base is a locked nucleic acid
tytgtggrmawarrgcyataggkwcagtr

SEQ ID NO: 10366 - DNA, 24 bp, Artificial Sequence
  Pan degenerate oligonucleotide primer
  primer_bind (1)..(24)
  modified_base (1)..(1): base is a locked nucleic acid
  modified_base (17)..(17): base is a locked nucleic acid
  misc_feature (18)..(24): Adaptor region of the pan degenerate sense primer that adapts the probe-binding site upstream of codon 76 to correspond to the nucleotides in an oligonucleotide probe upstream of the discriminating single nucleotide polymorphism.
  modified_base (20)..(20): base is a locked nucleic acid
ggrmawarrgcyataggkwcagtr

SEQ ID NO: 10367 - DNA, 24 bp, Artificial Sequence
  Pan degenerate oligonucleotide primer
  primer_bind (1)..(24)
  modified_base (1)..(1): base is a locked nucleic acid
  misc_feature (18)..(24): Adaptor region of the pan degenerate sense primer that adapts the probe-binding site upstream of codon 76 to correspond to the nucleotides in an oligonucleotide probe upstream of the discriminating single nucleotide polymorphism.
  modified_base (20)..(20): base is a locked nucleic acid
  modified_base (23)..(23): base is a locked nucleic acid
ggrmawarrgcyataggkwcagtr

SEQ ID NO: 10368 - DNA, 24 bp, Artificial Sequence
  Pan degenerate oligonucleotide primer
  primer_bind (1)..(24)
  modified_base (1)..(1): base is a locked nucleic acid
  modified_base (17)..(17): base is a locked nucleic acid
  misc_feature (18)..(24): Adaptor region of the pan degenerate sense primer that adapts the probe-binding site upstream of codon 76 to correspond to the nucleotides in an oligonucleotide probe upstream of the discriminating single nucleotide polymorphism.
  modified_base (23)..(23): base is a locked nucleic acid
ggrmawarrgcyataggkwcagtr

SEQ ID NO: 10369 - DNA, 40 bp, Artificial Sequence; identical to SEQ ID NO: 10354
  Pan degenerate oligonucleotide primer
  primer_bind (1)..(40)
  misc_feature (2)..(2): n is a, c, g, or t
  misc_feature (34)..(40): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10370 - DNA, 33 bp, Artificial Sequence; identical to SEQ ID NO: 10357
  Pan degenerate oligonucleotide primer
  primer_bind (1)..(33)
  misc_feature (27)..(33): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10371 - DNA, 32 bp, Artificial Sequence; identical to SEQ ID NO: 10360
  Pan degenerate oligonucleotide primer
  primer_bind (1)..(32)
  misc_feature (26)..(32): Adaptor region of the pan degenerate sense primer that adapts the probe-binding site upstream of codon 76 to correspond to the nucleotides in an oligonucleotide probe upstream of the discriminating single nucleotide polymorphism.

SEQ ID NO: 10372 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 76 to correspond to the nucleotides in an oligonucleotide probe upstream of the discriminating single nucleotide polymorphism.
tytgtggrmawarrgcyataggkwcagtr

SEQ ID NO: 10373 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 76 to correspond to the nucleotides in an oligonucleotide probe upstream of the discriminating single nucleotide polymorphism.
ggrmawarrgcyataggkwcagtr

SEQ ID NO: 10374 - DNA, 45 bp, Artificial Sequence
  Pan degenerate oligonucleotide primer
  primer_bind (1)..(45)
  misc_feature (7)..(7): n is a, c, g, or t
  misc_feature (39)..(45): Adaptor region of the pan degenerate sense primer that adapts the probe-binding site upstream of codon 76 to correspond to the nucleotides in an oligonucleotide probe upstream of the discriminating single nucleotide polymorphism.
savrtanhhrtagaratytgyggrmaharrryyryaggtacagta

SEQ ID NO: 10375 - DNA, 41 bp, Artificial Sequence
  Pan degenerate oligonucleotide primer
  primer_bind (1)..(41)
  misc_feature (2)..(2): n is a, c, g, or t
  misc_feature (34)..(40): Adaptor region of the pan degenerate sense primer that adapts the probe-binding site upstream of codon 76 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
anyyatagaaatytgtggrmawarrgcyataggkwcagtrn

SEQ ID NO: 10376 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 76 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
gaaatytgtggrmawarrgcyataggkwcagtrn

SEQ ID NO: 10377 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 76 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
aaatytgtggrmawarrgcyataggkwcagtrn

SEQ ID NO: 10378 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 76 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
tytgtggrmawarrgcyataggkwcagtrn

SEQ ID NO: 10379 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 76 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
ggrmawarrgcyataggkwcagtrn

SEQ ID NO: 10380 - DNA, 46 bp, Artificial Sequence
  Pan degenerate oligonucleotide primer
  primer_bind (1)..(46)
  misc_feature (7)..(7): n is a, c, g, or t
  misc_feature (39)..(45): Adaptor region of the pan degenerate sense primer that adapts the probe-binding site upstream of codon 76 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
savrtanhhrtagaratytgyggrmaharrryyryaggtacagtan

SEQ ID NO: 10381 - DNA, 40 bp, Artificial Sequence
  Pan degenerate oligonucleotide primer
  primer_bind (1)..(40)
  modified_base (14)..(14): base is a locked nucleic acid
  modified_base (17)..(17): base is a locked nucleic acid
  modified_base (20)..(20): base is a locked nucleic acid
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.
mawarrgcyataggkwcagtrytrrtrggrccyacacctr

SEQ ID NO: 10382 - DNA, 40 bp, Artificial Sequence; identical to SEQ ID NO: 10381
  Pan degenerate oligonucleotide primer
  primer_bind (1)..(40)
  modified_base (14)..(14): base is a locked nucleic acid
  modified_base (20)..(20): base is a locked nucleic acid
  modified_base (23)..(23): base is a locked nucleic acid
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.

SEQ ID NO: 10383 - DNA, 40 bp, Artificial Sequence; identical to SEQ ID NO: 10381
  Pan degenerate oligonucleotide primer
  primer_bind (1)..(40)
  modified_base (14)..(14): base is a locked nucleic acid
  modified_base (17)..(17): base is a locked nucleic acid
  modified_base (23)..(23): base is a locked nucleic acid
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.

SEQ ID NO: 10384 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacctr

SEQ ID NO: 10385 - DNA, 24 bp, Artificial Sequence
  Pan degenerate oligonucleotide primer
  primer_bind (1)..(24)
  modified_base (1)..(1): base is a locked nucleic acid
  modified_base (7)..(7): base is a locked nucleic acid
  modified_base (10)..(10): base is a locked nucleic acid
  misc_feature (18)..(24): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacctr

SEQ ID NO: 10386 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (10)..(10): base is a locked nucleic acid
  misc_feature (18)..(24): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacctr

SEQ ID NO: 10387 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (7)..(7): base is a locked nucleic acid
  misc_feature (15)..(21): Adaptor region of the pan degenerate sense primer that adapts the probe-binding site upstream of codon 82 to correspond to the nucleotides in an oligonucleotide probe upstream of the discriminating single nucleotide polymorphism.
trytrrtrggrccyacacctr

SEQ ID NO: 10388 - DNA, 21 bp, Artificial Sequence
  Pan degenerate oligonucleotide primer
  primer_bind (1)..(21)
  modified_base (1)..(1): base is a locked nucleic acid
  modified_base (7)..(7): base is a locked nucleic acid
  modified_base (9)..(9): base is a locked nucleic acid
  misc_feature (15)..(21): Adaptor region of the pan degenerate sense primer that adapts the probe-binding site upstream of codon 82 to correspond to the nucleotides in an oligonucleotide probe upstream of the discriminating single nucleotide polymorphism.
trytrrtrggrccyacacctr

SEQ ID NO: 10389 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (9)..(9): base is a locked nucleic acid
  misc_feature (15)..(21): Adaptor region of the pan degenerate sense primer that adapts the probe-binding site upstream of codon 82 to correspond to the nucleotides in an oligonucleotide probe upstream of the discriminating single nucleotide polymorphism.
trytrrtrggrccyacacctr

SEQ ID NO: 10390 - DNA, 40 bp, Artificial Sequence
  Pan degenerate oligonucleotide primer
  primer_bind (1)..(40)
  modified_base (15)..(15): base is a locked nucleic acid
  modified_base (18)..(18): base is a locked nucleic acid
  modified_base (21)..(21): base is a locked nucleic acid
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.
rmawarrgcyataggkwcagtrytrrtrggrccyacacct

SEQ ID NO: 10391 - DNA, 40 bp, Artificial Sequence; identical to SEQ ID NO: 10390
  Pan degenerate oligonucleotide primer
  primer_bind (1)..(40)
  modified_base (15)..(15): base is a locked nucleic acid
  modified_base (21)..(21): base is a locked nucleic acid
  modified_base (24)..(24): base is a locked nucleic acid
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.

SEQ ID NO: 10392 - DNA, 40 bp, Artificial Sequence; identical to SEQ ID NO: 10390
  Pan degenerate oligonucleotide primer
  primer_bind (1)..(40)
  modified_base (15)..(15): base is a locked nucleic acid
  modified_base (18)..(18): base is a locked nucleic acid
  modified_base (24)..(24): base is a locked nucleic acid
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.

SEQ ID NO: 10393 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (7)..(7): base is a locked nucleic acid
  misc_feature (17)..(23): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacct

SEQ ID NO: 10394 - DNA, 23 bp, Artificial Sequence
  Pan degenerate oligonucleotide primer
  primer_bind (1)..(23)
  modified_base (1)..(1): base is a locked nucleic acid
  modified_base (7)..(7): base is a locked nucleic acid
  modified_base (10)..(10): base is a locked nucleic acid
  misc_feature (17)..(23): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacct

SEQ ID NO: 10395 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (10)..(10): base is a locked nucleic acid
  misc_feature (17)..(23): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacct

SEQ ID NO: 10396 - DNA, 40 bp, Artificial Sequence; identical to SEQ ID NO: 10381
  Pan degenerate oligonucleotide primer
  primer_bind (1)..(40)
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.

SEQ ID NO: 10397 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacctr

SEQ ID NO: 10398 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 82 to correspond to the nucleotides in an oligonucleotide probe upstream of the discriminating single nucleotide polymorphism.
trytrrtrggrccyacacctr

SEQ ID NO: 10399 - DNA, 40 bp, Artificial Sequence; identical to SEQ ID NO: 10390
  Pan degenerate oligonucleotide primer
  primer_bind (1)..(40)
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.

SEQ ID NO: 10400 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 82 to correspond to the nucleotides in an oligonucleotide probe upstream of the discriminating single nucleotide polymorphism.
cagtrytrrtrggrccyacacct

SEQ ID NO: 10401 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 82 to correspond to the nucleotides in an oligonucleotide probe upstream of the discriminating single nucleotide polymorphism.
tgyggrmaharrryyryaggtacagtrttrrtaggrccyacacct

SEQ ID NO: 10402 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
mawarrgcyataggkwcagtrytrrtrggrccyacacctrn

SEQ ID NO: 10403 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 82 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
cagtrytrrtrggrccyacacctrn

SEQ ID NO: 10404 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 82 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
trytrrtrggrccyacacctrn

SEQ ID NO: 10405 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 82 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rmawarrgcyataggkwcagtrytrrtrggrccyacacctn

SEQ ID NO: 10406 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 82 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
cagtrytrrtrggrccyacacctn

SEQ ID NO: 10407 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 82 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
tgyggrmaharrryyryaggtacagtrttrrtaggrccyacacctn

SEQ ID NO: 10408 - DNA, 40 bp, Artificial Sequence
  Pan degenerate oligonucleotide primer
  primer_bind (1)..(40)
  modified_base (12)..(12): base is a locked nucleic acid
  modified_base (15)..(15): base is a locked nucleic acid
  modified_base (18)..(18): base is a locked nucleic acid
  misc_feature (34)..(40): Adaptor region of the pan degenerate sense primer that adapts the probe-binding site upstream of codon 83 to correspond to the nucleotides in an oligonucleotide probe upstream of the discriminating single nucleotide polymorphism.
warrgcyataggkwcagtrytrrtrggrccyacacctrtc

SEQ ID NO: 10409 - DNA, 40 bp, Artificial Sequence; identical to SEQ ID NO: 10408
  Pan degenerate oligonucleotide primer
  primer_bind (1)..(40)
  modified_base (12)..(12): base is a locked nucleic acid
  modified_base (18)..(18): base is a locked nucleic acid
  modified_base (21)..(21): base is a locked nucleic acid
  misc_feature (34)..(40): Adaptor region of the pan degenerate sense primer that adapts the probe-binding site upstream of codon 83 to correspond to the nucleotides in an oligonucleotide probe upstream of the discriminating single nucleotide polymorphism.

SEQ ID NO: 10410 - DNA, 40 bp, Artificial Sequence; identical to SEQ ID NO: 10408
  Pan degenerate oligonucleotide primer
  primer_bind (1)..(40)
  modified_base (12)..(12): base is a locked nucleic acid
  modified_base (15)..(15): base is a locked nucleic acid
  modified_base (21)..(21): base is a locked nucleic acid
  misc_feature (34)..(40): Adaptor region of the pan degenerate sense primer that adapts the probe-binding site upstream of codon 83 to correspond to the nucleotides in an oligonucleotide probe upstream of the discriminating single nucleotide polymorphism.

SEQ ID NO: 10411 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (7)..(7): base is a locked nucleic acid
  misc_feature (20)..(26): Adaptor region of the pan degenerate sense primer that adapts the probe-binding site upstream of codon 83 to correspond to the nucleotides in an oligonucleotide probe upstream of the discriminating single nucleotide polymorphism.
cagtrytrrtrggrccyacacctrtc

SEQ ID NO: 10412 - DNA, 26 bp, Artificial Sequence
  Pan degenerate oligonucleotide primer
  primer_bind (1)..(26)
  modified_base (1)..(1): base is a locked nucleic acid
  modified_base (7)..(7): base is a locked nucleic acid
  modified_base (10)..(10): base is a locked nucleic acid
  misc_feature (20)..(26): Adaptor region of the pan degenerate sense primer that adapts the probe-binding site upstream of codon 83 to correspond to the nucleotides in an oligonucleotide probe upstream of the discriminating single nucleotide polymorphism.
cagtrytrrtrggrccyacacctrtc

SEQ ID NO: 10413 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (10)..(10): base is a locked nucleic acid
  misc_feature (20)..(26): Adaptor region of the pan degenerate sense primer that adapts the probe-binding site upstream of codon 83 to correspond to the nucleotides in an oligonucleotide probe upstream of the discriminating single nucleotide polymorphism.
cagtrytrrtrggrccyacacctrtc

SEQ ID NO: 10414 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (7)..(7): base is a locked nucleic acid
  misc_feature (17)..(23): Adaptor region of the pan degenerate sense primer that adapts the probe-binding site upstream of codon 83 to correspond to the nucleotides in an oligonucleotide probe upstream of the discriminating single nucleotide polymorphism.
trytrrtrggrccyacacctrtc

SEQ ID NO: 10415 - DNA, 23 bp, Artificial Sequence
  Pan degenerate oligonucleotide primer
  primer_bind (1)..(23)
  modified_base (1)..(1): base is a locked nucleic acid
  modified_base (7)..(7): base is a locked nucleic acid
  modified_base (9)..(9): base is a locked nucleic acid
  misc_feature (17)..(23): Adaptor region of the pan degenerate sense primer that adapts the probe-binding site upstream of codon 83 to correspond to the nucleotides in an oligonucleotide probe upstream of the discriminating single nucleotide polymorphism.
trytrrtrggrccyacacctrtc

SEQ ID NO: 10416 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (9)..(9): base is a locked nucleic acid
  misc_feature (17)..(23): Adaptor region of the pan degenerate sense primer that adapts the probe-binding site upstream of codon 83 to correspond to the nucleotides in an oligonucleotide probe upstream of the discriminating single nucleotide polymorphism.
trytrrtrggrccyacacctrtc

SEQ ID NO: 10417 - DNA, 40 bp, Artificial Sequence; identical to SEQ ID NO: 10408
  Pan degenerate oligonucleotide primer
  primer_bind (1)..(40)
  misc_feature (34)..(40): Adaptor region of the pan degenerate sense primer that adapts the probe-binding site upstream of codon 83 to correspond to the nucleotides in an oligonucleotide probe upstream of the discriminating single nucleotide polymorphism.

SEQ ID NO: 10418 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 83 to correspond to the nucleotides in an oligonucleotide probe upstream of the discriminating single nucleotide polymorphism.
cagtrytrrtrggrccyacacctrtc

SEQ ID NO: 10419 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 83 to correspond to the nucleotides in an oligonucleotide probe upstream of the discriminating single nucleotide polymorphism.
trytrrtrggrccyacacctrtc

SEQ ID NO: 10420 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 83 to correspond to the nucleotides in an oligonucleotide probe upstream of the discriminating single nucleotide polymorphism.
ggrmaharrryyryaggtacagtrttrrtaggrccyacacctgtc

SEQ ID NO: 10421 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 83 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
warrgcyataggkwcagtrytrrtrggrccyacacctrtcn

SEQ ID NO: 10422 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 83 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
cagtrytrrtrggrccyacacctrtcn

SEQ ID NO: 10423 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 83 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
trytrrtrggrccyacacctrtcn

SEQ ID NO: 10424 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 83 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ggrmaharrryyryaggtacagtrttrrtaggrccyacacctgtcn

SEQ ID NO: 10425 - DNA, 40 bp, Artificial Sequence
  Pan degenerate oligonucleotide primer
  primer_bind (1)..(40)
  modified_base (9)..(9): base is a locked nucleic acid
  modified_base (12)..(12): base is a locked nucleic acid
  modified_base (15)..(15): base is a locked nucleic acid
  misc_feature (34)..(40): Adaptor region of the pan degenerate sense primer that adapts the probe-binding site upstream of codon 84 to correspond to the nucleotides in an oligonucleotide probe upstream of the discriminating single nucleotide polymorphism.
rgcyataggkwcagtrytrrtrggrccyacacctrtcaac

SEQ ID NO: 10426 - DNA, 40 bp, Artificial Sequence; identical to SEQ ID NO: 10425
  Pan degenerate oligonucleotide primer
  primer_bind (1)..(40)
  modified_base (9)..(9): base is a locked nucleic acid
  modified_base (15)..(15): base is a locked nucleic acid
  modified_base (18)..(18): base is a locked nucleic acid
  misc_feature (34)..(40): Adaptor region of the pan degenerate sense primer that adapts the probe-binding site upstream of codon 84 to correspond to the nucleotides in an oligonucleotide probe upstream of the discriminating single nucleotide polymorphism.

SEQ ID NO: 10427 - DNA, 40 bp, Artificial Sequence; identical to SEQ ID NO: 10425
  Pan degenerate oligonucleotide primer
  primer_bind (1)..(40)
  modified_base (9)..(9): base is a locked nucleic acid
  modified_base (12)..(12): base is a locked nucleic acid
  modified_base (18)..(18): base is a locked nucleic acid
  misc_feature (34)..(40): Adaptor region of the pan degenerate sense primer that adapts the probe-binding site upstream of codon 84 to correspond to the nucleotides in an oligonucleotide probe upstream of the discriminating single nucleotide polymorphism.

SEQ ID NO: 10428 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate sense primer that adapts the probe-binding site upstream of codon 84 to correspond to the nucleotides in an oligonucleotide probe upstream of the discriminating single nucleotide polymorphism.
cagtrytrrtrggrccyacacctrtcaac

SEQ ID NO: 10429 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (10)..(10): base is a locked nucleic acid
  misc_feature (23)..(29): Adaptor region of the pan degenerate sense primer that adapts the probe-binding site upstream of codon 84 to correspond to the nucleotides in an oligonucleotide probe upstream of the discriminating single nucleotide polymorphism.
cagtrytrrtrggrccyacacctrtcaac

SEQ ID NO: 10430 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (10)..(10): base is a locked nucleic acid
  misc_feature (23)..(29): Adaptor region of the pan degenerate sense primer that adapts the probe-binding site upstream of codon 84 to correspond to the nucleotides in an oligonucleotide probe upstream of the discriminating single nucleotide polymorphism.
cagtrytrrtrggrccyacacctrtcaac

SEQ ID NO: 10431 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (7)..(7): base is a locked nucleic acid
  misc_feature (20)..(26): Adaptor region of the pan degenerate sense primer that adapts the probe-binding site upstream of codon 84 to correspond to the nucleotides in an oligonucleotide probe upstream of the discriminating single nucleotide polymorphism.
trytrrtrggrccyacacctrtcaac

SEQ ID NO: 10432 - DNA, 26 bp, Artificial Sequence
  Pan degenerate oligonucleotide primer
  primer_bind (1)..(26)
  modified_base (1)..(1): base is a locked nucleic acid
  modified_base (7)..(7): base is a locked nucleic acid
  modified_base (9)..(9): base is a locked nucleic acid
  misc_feature (20)..(26): Adaptor region of the pan degenerate sense primer that adapts the probe-binding site upstream of codon 84 to correspond to the nucleotides in an oligonucleotide probe upstream of the discriminating single nucleotide polymorphism.
trytrrtrggrccyacacctrtcaac

SEQ ID NO: 10433 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (9)..(9): base is a locked nucleic acid
  misc_feature (20)..(26): Adaptor region of the pan degenerate sense primer that adapts the probe-binding site upstream of codon 84 to correspond to the nucleotides in an oligonucleotide probe upstream of the discriminating single nucleotide polymorphism.
trytrrtrggrccyacacctrtcaac

SEQ ID NO: 10434 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (6)..(6): base is a locked nucleic acid
  misc_feature (17)..(23): Adaptor region of the pan degenerate sense primer that adapts the probe-binding site upstream of codon 84 to correspond to the nucleotides in an oligonucleotide probe upstream of the discriminating single nucleotide polymorphism.
trrtrggrccyacacctrtcaac

SEQ ID NO: 10435 - DNA, 23 bp, Artificial Sequence
  Pan degenerate oligonucleotide primer
  primer_bind (1)..(23)
  modified_base (1)..(1): base is a locked nucleic acid
  modified_base (6)..(6): base is a locked nucleic acid
  modified_base (7)..(7): base is a locked nucleic acid
  misc_feature (17)..(23): Adaptor region of the pan degenerate sense primer that adapts the probe-binding site upstream of codon 84 to correspond to the nucleotides in an oligonucleotide probe upstream of the discriminating single nucleotide polymorphism.
trrtrggrccyacacctrtcaac

SEQ ID NO: 10436 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (7)..(7): base is a locked nucleic acid
  misc_feature (17)..(23): Adaptor region of the pan degenerate sense primer that adapts the probe-binding site upstream of codon 84 to correspond to the nucleotides in an oligonucleotide probe upstream of the discriminating single nucleotide polymorphism.
trrtrggrccyacacctrtcaac

SEQ ID NO: 10437 - DNA, 40 bp, Artificial Sequence; identical to SEQ ID NO: 10425
  Pan degenerate oligonucleotide primer
  primer_bind (1)..(40)
  misc_feature (34)..(40): Adaptor region of the pan degenerate sense primer that adapts the probe-binding site upstream of codon 84 to correspond to the nucleotides in an oligonucleotide probe upstream of the discriminating single nucleotide polymorphism.

SEQ ID NO: 10438 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 84 to correspond to the nucleotides in an oligonucleotide probe upstream of the discriminating single nucleotide polymorphism.
cagtrytrrtrggrccyacacctrtcaac

SEQ ID NO: 10439 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 84 to correspond to the nucleotides in an oligonucleotide probe upstream of the discriminating single nucleotide polymorphism.
trytrrtrggrccyacacctrtcaac

SEQ ID NO: 10440 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 84 to correspond to the nucleotides in an oligonucleotide probe upstream of the discriminating single nucleotide polymorphism.
trrtrggrccyacacctrtcaac

SEQ ID NO: 10441 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 84 to correspond to the nucleotides in an oligonucleotide probe upstream of the discriminating single nucleotide polymorphism.
maharrryyryaggtacagtrttrrtaggrccyacmcctgtcaac

SEQ ID NO: 10442 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 84 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rgcyataggkwcagtrytrrtrggrccyacacctrtcaacn

SEQ ID NO: 10443 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 84 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
cagtrytrrtrggrccyacacctrtcaacn

SEQ ID NO: 10444 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 84 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
trytrrtrggrccyacacctrtcaacn

SEQ ID NO: 10445 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 84 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
trrtrggrccyacacctrtcaacn

SEQ ID NO: 10446 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 84 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
maharrryyryaggtacagtrttrrtaggrccyacmcctgtcaacn

SEQ ID NO: 10447 - DNA, 40 bp, Artificial Sequence
  Pan degenerate oligonucleotide primer
  primer_bind (1)..(40)
  modified_base (2)..(2): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 88 to correspond to the nucleotides in an oligonucleotide probe upstream of the discriminating single nucleotide polymorphism.
gtrytrrtrggrccyacacctrtcaacataattggrmgra

SEQ ID NO: 10448 - DNA, 40 bp, Artificial Sequence; identical to SEQ ID NO: 10447
  Pan degenerate oligonucleotide primer
  primer_bind (1)..(40)
  modified_base (2)..(2): base is a locked nucleic acid
  modified_base (8)..(8): base is a locked nucleic acid
  modified_base (10)..(10): base is a locked nucleic acid
  misc_feature (34)..(40): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10449 - DNA, 40 bp, Artificial Sequence; identical to SEQ ID NO: 10447
  Pan degenerate oligonucleotide primer
  primer_bind (1)..(40)
  modified_base (2)..(2): base is a locked nucleic acid
  modified_base (5)..(5): base is a locked nucleic acid
  modified_base (10)..(10): base is a locked nucleic acid
  misc_feature (34)..(40): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10450 - DNA, 36 bp, Artificial Sequence
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 88 to correspond to the nucleotides in an oligonucleotide probe upstream of the discriminating single nucleotide polymorphism.
trrtrggrccyacacctrtcaacataattggrmgra

SEQ ID NO: 10451 - DNA, 36 bp, Artificial Sequence; identical to SEQ ID NO: 10450
  Pan degenerate oligonucleotide primer
  primer_bind (1)..(36)
  modified_base (1)..(1): base is a locked nucleic acid
  modified_base (6)..(6): base is a locked nucleic acid
  modified_base (7)..(7): base is a locked nucleic acid
  misc_feature (30)..(36): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10452 - DNA, 36 bp, Artificial Sequence; identical to SEQ ID NO: 10450
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10453 - DNA, 33 bp, Artificial Sequence
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 88 to correspond to the nucleotides in an oligonucleotide probe upstream of the discriminating single nucleotide polymorphism.
trggrccyacacctrtcaacataattggrmgra

SEQ ID NO: 10454 - DNA, 33 bp, Artificial Sequence; identical to SEQ ID NO: 10453
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10455 - DNA, 33 bp, Artificial Sequence; identical to SEQ ID NO: 10453
  Pan degenerate oligonucleotide primer
  primer_bind (1)..(33)
  modified_base (1)..(1): base is a locked nucleic acid
  modified_base (3)..(3): base is a locked nucleic acid
  modified_base (7)..(7): base is a locked nucleic acid
  misc_feature (27)..(33): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10456 - DNA, 31 bp, Artificial Sequence
  Pan degenerate oligonucleotide primer
  primer_bind (1)..(31)
  modified_base (1)..(1): base is a locked nucleic acid
  modified_base (2)..(2): base is a locked nucleic acid
  modified_base (5)..(5): base is a locked nucleic acid
  misc_feature (25)..(31): Adaptor region of the pan degenerate sense primer that adapts the probe-binding site upstream of codon 88 to correspond to the nucleotides in an oligonucleotide probe upstream of the discriminating single nucleotide polymorphism.
ggrccyacacctrtcaacataattggrmgra

SEQ ID NO: 10457 - DNA, 31 bp, Artificial Sequence; identical to SEQ ID NO: 10456
  Pan degenerate oligonucleotide primer
  primer_bind (1)..(31)
  modified_base (1)..(1): base is a locked nucleic acid
  modified_base (5)..(5): base is a locked nucleic acid
  modified_base (7)..(7): base is a locked nucleic acid
  misc_feature (25)..(31): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10458 - DNA, 31 bp, Artificial Sequence; identical to SEQ ID NO: 10456
  Pan degenerate oligonucleotide primer
  primer_bind (1)..(31)
  modified_base (1)..(1): base is a locked nucleic acid
  modified_base (2)..(2): base is a locked nucleic acid
  modified_base (7)..(7): base is a locked nucleic acid
  misc_feature (25)..(31): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10459 - DNA, 30 bp, Artificial Sequence
  Pan degenerate oligonucleotide primer
  primer_bind (1)..(30)
  modified_base (1)..(1): base is a locked nucleic acid
  modified_base (4)..(4): base is a locked nucleic acid
  modified_base (6)..(6): base is a locked nucleic acid
  misc_feature (24)..(30): Adaptor region of the pan degenerate sense primer that adapts the probe-binding site upstream of codon 88 to correspond to the nucleotides in an oligonucleotide probe upstream of the discriminating single nucleotide polymorphism.
grccyacacctrtcaacataattggrmgra

SEQ ID NO: 10460 - DNA, 30 bp, Artificial Sequence; identical to SEQ ID NO: 10459
  Pan degenerate oligonucleotide primer
  primer_bind (1)..(30)
  modified_base (1)..(1): base is a locked nucleic acid
  modified_base (6)..(6): base is a locked nucleic acid
  modified_base (7)..(7): base is a locked nucleic acid
  misc_feature (24)..(30): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10461 - DNA, 30 bp, Artificial Sequence; identical to SEQ ID NO: 10459
  Pan degenerate oligonucleotide primer
  primer_bind (1)..(30)
  modified_base (1)..(1): base is a locked nucleic acid
  modified_base (4)..(4): base is a locked nucleic acid
  modified_base (7)..(7): base is a locked nucleic acid
  misc_feature (24)..(30): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10462 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (4)..(4): base is a locked nucleic acid
  misc_feature (21)..(27): Adaptor region of the pan degenerate sense primer that adapts the probe-binding site upstream of codon 88 to correspond to the nucleotides in an oligonucleotide probe upstream of the discriminating single nucleotide polymorphism.
cyacacctrtcaacataattggrmgra

SEQ ID NO: 10463 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (6)..(6): base is a locked nucleic acid
  misc_feature (21)..(27): Adaptor region of the pan degenerate sense primer that adapts the probe-binding site upstream of codon 88 to correspond to the nucleotides in an oligonucleotide probe upstream of the discriminating single nucleotide polymorphism.
cyacacctrtcaacataattggrmgra

SEQ ID NO: 10464 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (6)..(6): base is a locked nucleic acid
  misc_feature (21)..(27): Adaptor region of the pan degenerate sense primer that adapts the probe-binding site upstream of codon 88 to correspond to the nucleotides in an oligonucleotide probe upstream of the discriminating single nucleotide polymorphism.
cyacacctrtcaacataattggrmgra

SEQ ID NO: 10465 - DNA, 40 bp, Artificial Sequence; identical to SEQ ID NO: 10447
  Pan degenerate oligonucleotide primer
  primer_bind (1)..(40)
  misc_feature (34)..(40): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10466 - DNA, 36 bp, Artificial Sequence; identical to SEQ ID NO: 10450
  Pan degenerate oligonucleotide primer
  primer_bind (1)..(36)
  misc_feature (30)..(36): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10467 - DNA, 33 bp, Artificial Sequence; identical to SEQ ID NO: 10453
  Pan degenerate oligonucleotide primer
  primer_bind (1)..(33)
  misc_feature (27)..(33): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10468 - DNA, 31 bp, Artificial Sequence; identical to SEQ ID NO: 10456
  Pan degenerate oligonucleotide primer
  primer_bind (1)..(31)
  misc_feature (25)..(31): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10469 - DNA, 30 bp, Artificial Sequence; identical to SEQ ID NO: 10459
  Pan degenerate oligonucleotide primer
  primer_bind (1)..(30)
  misc_feature (24)..(30): Adaptor region of the pan degenerate sense primer that adapts the probe-binding site upstream of codon 88 to correspond to the nucleotides in an oligonucleotide probe upstream of the discriminating single nucleotide polymorphism.

SEQ ID NO: 10470 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 88 to correspond to the nucleotides in an oligonucleotide probe upstream of the discriminating single nucleotide polymorphism.
cyacacctrtcaacataattggrmgra

SEQ ID NO: 10471 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 88 to correspond to the nucleotides in an oligonucleotide probe upstream of the discriminating single nucleotide polymorphism.
ggtacagtrttrrtaggrccyacmcctrycaacataattggaaga

SEQ ID NO: 10472 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 88 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gtrytrrtrggrccyacacctrtcaacataattggrmgran

SEQ ID NO: 10473 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 88 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
trrtrggrccyacacctrtcaacataattggrmgran

SEQ ID NO: 10474 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 88 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
trggrccyacacctrtcaacataattggrmgran

SEQ ID NO: 10475 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 88 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
ggrccyacacctrtcaacataattggrmgran

SEQ ID NO: 10476 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 88 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
grccyacacctrtcaacataattggrmgran

SEQ ID NO: 10477 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 88 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
cyacacctrtcaacataattggrmgran

SEQ ID NO: 10478 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 88 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ggtacagtrttrrtaggrccyacmcctrycaacataattggaagan

SEQ ID NO: 10479 - DNA, 40 bp, Artificial Sequence
  Pan degenerate oligonucleotide primer
  primer_bind (1)..(40)
  modified_base (3)..(3): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 89 to correspond to the nucleotides in an oligonucleotide probe upstream of the discriminating single nucleotide polymorphism.
rytrrtrggrccyacacctrtcaacataattggrmgraay

SEQ ID NO: 10480 - DNA, 40 bp, Artificial Sequence; identical to SEQ ID NO: 10479
  Pan degenerate oligonucleotide primer
  primer_bind (1)..(40)
  modified_base (3)..(3): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10481 - DNA, 40 bp, Artificial Sequence; identical to SEQ ID NO: 10479
  Pan degenerate oligonucleotide primer
  primer_bind (1)..(40)
  modified_base (3)..(3): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10482 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 89 to correspond to the nucleotides in an oligonucleotide probe upstream of the discriminating single nucleotide polymorphism.
trggrccyacacctrtcaacataattggrmgraay

SEQ ID NO: 10483 - DNA, 35 bp, Artificial Sequence; identical to SEQ ID NO: 10482
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10484 - DNA, 35 bp, Artificial Sequence; identical to SEQ ID NO: 10482
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10485 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 89 to correspond to the nucleotides in an oligonucleotide probe upstream of the discriminating single nucleotide polymorphism.
ggrccyacacctrtcaacataattggrmgraay

SEQ ID NO: 10486 - DNA, 33 bp, Artificial Sequence; identical to SEQ ID NO: 10485
  Pan degenerate oligonucleotide primer
  primer_bind (1)..(33)
  modified_base (1)..(1): base is a locked nucleic acid
  modified_base (5)..(5): base is a locked nucleic acid
  modified_base (7)..(7): base is a locked nucleic acid
  misc_feature (27)..(33): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10487 - DNA, 33 bp, Artificial Sequence; identical to SEQ ID NO: 10485
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10488 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 89 to correspond to the nucleotides in an oligonucleotide probe upstream of the discriminating single nucleotide polymorphism.
grccyacacctrtcaacataattggrmgraay

SEQ ID NO: 10489 - DNA, 32 bp, Artificial Sequence; identical to SEQ ID NO: 10488
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10490 - DNA, 32 bp, Artificial Sequence; identical to SEQ ID NO: 10488
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10491 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 89 to correspond to the nucleotides in an oligonucleotide probe upstream of the discriminating single nucleotide polymorphism.
cyacacctrtcaacataattggrmgraay

SEQ ID NO: 10492 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate sense primer that adapts the probe-binding site upstream of codon 89 to correspond to the nucleotides in an oligonucleotide probe upstream of the discriminating single nucleotide polymorphism.
cyacacctrtcaacataattggrmgraay

SEQ ID NO: 10493 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate sense primer that adapts the probe-binding site upstream of codon 89 to correspond to the nucleotides in an oligonucleotide probe upstream of the discriminating single nucleotide polymorphism.
cyacacctrtcaacataattggrmgraay

SEQ ID NO: 10494 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (4)..(4): base is a locked nucleic acid
  misc_feature (21)..(27): Adaptor region of the pan degenerate sense primer that adapts the probe-binding site upstream of codon 89 to correspond to the nucleotides in an oligonucleotide probe upstream of the discriminating single nucleotide polymorphism.
acacctrtcaacataattggrmgraay

SEQ ID NO: 10495 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate sense primer that adapts the probe-binding site upstream of codon 89 to correspond to the nucleotides in an oligonucleotide probe upstream of the discriminating single nucleotide polymorphism.
acacctrtcaacataattggrmgraay

SEQ ID NO: 10496 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate sense primer that adapts the probe-binding site upstream of codon 89 to correspond to the nucleotides in an oligonucleotide probe upstream of the discriminating single nucleotide polymorphism.
acacctrtcaacataattggrmgraay

SEQ ID NO: 10497 - DNA, 40 bp, Artificial Sequence; identical to SEQ ID NO: 10479
  Pan degenerate oligonucleotide primer
  primer_bind (1)..(40)
  misc_feature (34)..(40): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10498 - DNA, 35 bp, Artificial Sequence; identical to SEQ ID NO: 10482
  Pan degenerate oligonucleotide primer
  primer_bind (1)..(35)
  misc_feature (29)..(35): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10499 - DNA, 33 bp, Artificial Sequence; identical to SEQ ID NO: 10485
  Pan degenerate oligonucleotide primer
  primer_bind (1)..(33)
  misc_feature (27)..(33): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10500 - DNA, 32 bp, Artificial Sequence; identical to SEQ ID NO: 10488
  Pan degenerate oligonucleotide primer
  primer_bind (1)..(32)
  misc_feature (26)..(32): Adaptor region of the pan degenerate sense primer that adapts the probe-binding site upstream of codon 89 to correspond to the nucleotides in an oligonucleotide probe upstream of the discriminating single nucleotide polymorphism.

SEQ ID NO: 10501 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 89 to correspond to the nucleotides in an oligonucleotide probe upstream of the discriminating single nucleotide polymorphism.
cyacacctrtcaacataattggrmgraay

SEQ ID NO: 10502 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 89 to correspond to the nucleotides in an oligonucleotide probe upstream of the discriminating single nucleotide polymorphism.
acacctrtcaacataattggrmgraay

SEQ ID NO: 10503 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 89 to correspond to the nucleotides in an oligonucleotide probe upstream of the discriminating single nucleotide polymorphism.
acagtrttrrtaggrccyacmcctrycaacataattggaagaaat

SEQ ID NO: 10504 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 89 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rytrrtrggrccyacacctrtcaacataattggrmgraayn

SEQ ID NO: 10505 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 89 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
trggrccyacacctrtcaacataattggrmgraayn

SEQ ID NO: 10506 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 89 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ggrccyacacctrtcaacataattggrmgraayn

SEQ ID NO: 10507 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 89 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
grccyacacctrtcaacataattggrmgraayn

SEQ ID NO: 10508 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 89 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
cyacacctrtcaacataattggrmgraayn

SEQ ID NO: 10509 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 89 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
acacctrtcaacataattggrmgraayn

SEQ ID NO: 10510 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 89 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
acagtrttrrtaggrccyacmcctrycaacataattggaagaaatn

SEQ ID NO: 10511 - DNA, 40 bp, Artificial Sequence
  Pan degenerate oligonucleotide primer
  primer_bind (1)..(40)
  modified_base (3)..(3): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.
rrtrggrccyacacctrtcaacataattggrmgraayhtg

SEQ ID NO: 10512 - DNA, 40 bp, Artificial Sequence; identical to SEQ ID NO: 10511
  Pan degenerate oligonucleotide primer
  primer_bind (1)..(40)
  modified_base (3)..(3): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10513 - DNA, 40 bp, Artificial Sequence; identical to SEQ ID NO: 10511
  Pan degenerate oligonucleotide primer
  primer_bind (1)..(40)
  modified_base (3)..(3): base is a locked nucleic acid
  modified_base (5)..(5): base is a locked nucleic acid
  modified_base (9)..(9): base is a locked nucleic acid
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10514 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 90 to correspond to the nucleotides in an oligonucleotide probe upstream of the discriminating single nucleotide polymorphism.
ggrccyacacctrtcaacataattggrmgraayhtg

SEQ ID NO: 10515 - DNA, 36 bp, Artificial Sequence; identical to SEQ ID NO: 10514
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (30)..(36): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10516 - DNA, 36 bp, Artificial Sequence; identical to SEQ ID NO: 10514
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (30)..(36): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10517 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.
grccyacacctrtcaacataattggrmgraayhtg

SEQ ID NO: 10518 - DNA, 35 bp, Artificial Sequence; identical to SEQ ID NO: 10517
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10519 - DNA, 35 bp, Artificial Sequence; identical to SEQ ID NO: 10517
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10520 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.
cyacacctrtcaacataattggrmgraayhtg

SEQ ID NO: 10521 - DNA, 32 bp, Artificial Sequence; identical to SEQ ID NO: 10520
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10522 - DNA, 32 bp, Artificial Sequence; identical to SEQ ID NO: 10520
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10523 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.
acacctrtcaacataattggrmgraayhtg

SEQ ID NO: 10524 - DNA, 30 bp, Artificial Sequence; identical to SEQ ID NO: 10523
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10525 - DNA, 30 bp, Artificial Sequence; identical to SEQ ID NO: 10523
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10526 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
cacctrtcaacataattggrmgraayhtg

SEQ ID NO: 10527 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (9)..(9): base is a locked nucleic acid
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
cacctrtcaacataattggrmgraayhtg

SEQ ID NO: 10528 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (9)..(9): base is a locked nucleic acid
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
cacctrtcaacataattggrmgraayhtg

SEQ ID NO: 10529 - DNA, 40 bp, Artificial Sequence; identical to SEQ ID NO: 10511
  Pan degenerate oligonucleotide primer
  primer_bind (1)..(40)
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10530 - DNA, 36 bp, Artificial Sequence; identical to SEQ ID NO: 10514
  Pan degenerate oligonucleotide primer
  primer_bind (1)..(36)
  misc_feature (30)..(36): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10531 - DNA, 35 bp, Artificial Sequence; identical to SEQ ID NO: 10517
  Pan degenerate oligonucleotide primer
  primer_bind (1)..(35)
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10532 - DNA, 32 bp, Artificial Sequence; identical to SEQ ID NO: 10520
  Pan degenerate oligonucleotide primer
  primer_bind (1)..(32)
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10533 - DNA, 30 bp, Artificial Sequence; identical to SEQ ID NO: 10523
  Pan degenerate oligonucleotide primer
  primer_bind (1)..(30)
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 10534 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
cacctrtcaacataattggrmgraayhtg

SEQ ID NO: 10535 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 90 to correspond to the nucleotides in an oligonucleotide probe upstream of the discriminating single nucleotide polymorphism.
gtrttrrtaggrccyacmcctrycaacataattggrmgaaatctg

SEQ ID NO: 10536 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rrtrggrccyacacctrtcaacataattggrmgraayhtgn

SEQ ID NO: 10537 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 90 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ggrccyacacctrtcaacataattggrmgraayhtgn

SEQ ID NO: 10538 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
grccyacacctrtcaacataattggrmgraayhtgn

SEQ ID NO: 10539 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
cyacacctrtcaacataattggrmgraayhtgn

SEQ ID NO: 10540 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
acacctrtcaacataattggrmgraayhtgn

SEQ ID NO: 10541 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
cacctrtcaacataattggrmgraayhtgn

SEQ ID NO: 10542 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 90 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gtrttrrtaggrccyacmcctrycaacataattggrmgaaatctgn

SEQ ID NO: 10543 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 10 to correspond to the nucleotides in an oligonucleotide probe downstream of the discriminating single nucleotide polymorphism.
tcctgtrtctaakagrgcytcyhtyrdytgbccyyctayyyttaytgtgac

SEQ ID NO: 10544 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 10 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tcctgtrtctaakagrgcytcyhtyrdytgbccyyctayyyttaytgtgacn

SEQ ID NO: 10545 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 11 to correspond to the nucleotides in an oligonucleotide probe downstream of the discriminating single nucleotide polymorphism.
tgctcctgtrtctaakagrgcytcyhtyrdytgbccyyctayyyttattgt

SEQ ID NO: 10546 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 11 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tgctcctgtrtctaakagrgcytcyhtyrdytgbccyyctayyyttattgtn

SEQ ID NO: 10547 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 20 to correspond to the nucleotides in an oligonucleotide probe downstream of the discriminating single nucleotide polymorphism.
myyyatdtcttctaatactgtatcatctgctcctgtrtctaakagagcttc

SEQ ID NO: 10548 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 20 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
myyyatdtcttctaatactgtatcatctgctcctgtrtctaakagagcttcn

SEQ ID NO: 10549 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 23 to correspond to the nucleotides in an oligonucleotide probe downstream of the discriminating single nucleotide polymorphism.
ycctggyaamyyyatdtcttctaatactgtatcatctgctcctgtatctaa

SEQ ID NO: 10550 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 23 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ycctggyaamyyyatdtcttctaatactgtatcatctgctcctgtatctaan

SEQ ID NO: 10551 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 24 to correspond to the nucleotides in an oligonucleotide probe downstream of the discriminating single nucleotide polymorphism.
tytycctggyaamyyyatdtcttctaatactgtatcatctgctcctgtatc

SEQ ID NO: 10552 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 24 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tytycctggyaamyyyatdtcttctaatactgtatcatctgctcctgtatcn

SEQ ID NO: 10553 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 30 to correspond to the nucleotides in an oligonucleotide probe downstream of the discriminating single nucleotide polymorphism.
tatyatttttggyttccatytycctggyaamyyyatdtcttctaatactgt

SEQ ID NO: 10554 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 30 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tatyatttttggyttccatytycctggyaamyyyatdtcttctaatactgtn

SEQ ID NO: 10555 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 32 to correspond to the nucleotides in an oligonucleotide probe downstream of the discriminating single nucleotide polymorphism.
tccycctatyatttttggyttccatytycctggyaamyyyatdtcttctaa

SEQ ID NO: 10556 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 32 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tccycctatyatttttggyttccatytycctggyaamyyyatdtcttctaan

SEQ ID NO: 10557 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 33 to correspond to the nucleotides in an oligonucleotide probe downstream of the discriminating single nucleotide polymorphism.
aattccycctatyatttttggyttccatytycctggyaamyyyatttcttc

SEQ ID NO: 10558 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 33 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
aattccycctatyatttttggyttccatytycctggyaamyyyatttcttcn

SEQ ID NO: 10559 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 43 to correspond to the nucleotides in an oligonucleotide probe downstream of the discriminating single nucleotide polymorphism.
mtcataytgyyttacyttrayaaarcctccaattccycctatyatttttgg

SEQ ID NO: 10560 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 43 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
mtcataytgyyttacyttrayaaarcctccaattccycctatyatttttggn

SEQ ID NO: 10561 - DNA, 51 bp, Artificial Sequence
  Pan degenerate oligonucleotide primer
  primer_bind (1)..(51)
  misc_feature (3)..(3): n is a, c, g, or t
  misc_feature (45)..(51): Adaptor region of the pan degenerate antisense primer that adapts the probe-binding site downstream of codon 46 to correspond to the nucleotides in an oligonucleotide probe downstream of the discriminating single nucleotide polymorphism.
ddntaybtsmtcataytgyyttacyttrayaaarcctccaattccccctat

SEQ ID NO: 10562 - DNA, 52 bp, Artificial Sequence
  Pan degenerate oligonucleotide primer
  primer_bind (1)..(52)
  misc_feature (3)..(3): n is a, c, g, or t
  misc_feature (45)..(51): Adaptor region of the pan degenerate antisense primer that adapts the probe-binding site downstream of codon 46 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ddntaybtsmtcataytgyyttacyttrayaaarcctccaattccccctatn

SEQ ID NO: 10563 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (3)..(3): base is a locked nucleic acid
  misc_feature (34)..(40): Adaptor region of the pan degenerate antisense primer that adapts the probe-binding site downstream of codon 47 to correspond to the nucleotides in an oligonucleotide probe downstream of the discriminating single nucleotide polymorphism.
tcataytgyyttacyttrataaarcctccaattccyccta

SEQ ID NO: 10564 - DNA, 40 bp, Artificial Sequence; identical to SEQ ID NO: 10563
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10565 - DNA, 40 bp, Artificial Sequence; identical to SEQ ID NO: 10563
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10566 - DNA, 39 bp, Artificial Sequence
  Pan degenerate oligonucleotide primer
  primer_bind (1)..(39)
  modified_base (1)..(1): base is a locked nucleic acid
  modified_base (2)..(2): base is a locked nucleic acid
  modified_base (3)..(3): base is a locked nucleic acid
  misc_feature (33)..(39): Adaptor region of the pan degenerate antisense primer that adapts the probe-binding site downstream of codon 47 to correspond to the nucleotides in an oligonucleotide probe downstream of the discriminating single nucleotide polymorphism.
cataytgyyttacyttrataaarcctccaattccyccta

SEQ ID NO: 10567 - DNA, 39 bp, Artificial Sequence; identical to SEQ ID NO: 10566
  Pan degenerate oligonucleotide primer
  primer_bind (1)..(39)
  modified_base (1)..(1): base is a locked nucleic acid
  modified_base (3)..(3): base is a locked nucleic acid
  modified_base (5)..(5): base is a locked nucleic acid
  misc_feature (33)..(39): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10568 - DNA, 39 bp, Artificial Sequence; identical to SEQ ID NO: 10566
  Pan degenerate oligonucleotide primer
  primer_bind (1)..(39)
  modified_base (1)..(1): base is a locked nucleic acid
  modified_base (2)..(2): base is a locked nucleic acid
  modified_base (5)..(5): base is a locked nucleic acid
  misc_feature (33)..(39): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10569 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 47 to correspond to the nucleotides in an oligonucleotide probe downstream of the discriminating single nucleotide polymorphism.
ataytgyyttacyttrataaarcctccaattccyccta

SEQ ID NO: 10570 - DNA, 38 bp, Artificial Sequence; identical to SEQ ID NO: 10569
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10571 - DNA, 38 bp, Artificial Sequence; identical to SEQ ID NO: 10569
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10572 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 47 to correspond to the nucleotides in an oligonucleotide probe downstream of the discriminating single nucleotide polymorphism.
taytgyyttacyttrataaarcctccaattccyccta

SEQ ID NO: 10573 - DNA, 37 bp, Artificial Sequence; identical to SEQ ID NO: 10572
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10574 - DNA, 37 bp, Artificial Sequence; identical to SEQ ID NO: 10572
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10575 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 47 to correspond to the nucleotides in an oligonucleotide probe downstream of the discriminating single nucleotide polymorphism.
ytgyyttacyttrataaarcctccaattccyccta

SEQ ID NO: 10576 - DNA, 35 bp, Artificial Sequence; identical to SEQ ID NO: 10575
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10577 - DNA, 35 bp, Artificial Sequence; identical to SEQ ID NO: 10575
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10578 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 47 to correspond to the nucleotides in an oligonucleotide probe downstream of the discriminating single nucleotide polymorphism.
tgyyttacyttrataaarcctccaattccyccta

SEQ ID NO: 10579 - DNA, 34 bp, Artificial Sequence; identical to SEQ ID NO: 10578
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10580 - DNA, 34 bp, Artificial Sequence; identical to SEQ ID NO: 10578
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10581 - DNA, 40 bp, Artificial Sequence; identical to SEQ ID NO: 10563
  Pan degenerate oligonucleotide primer
  primer_bind (1)..(40)
  misc_feature (34)..(40): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10582 - DNA, 39 bp, Artificial Sequence; identical to SEQ ID NO: 10566
  Pan degenerate oligonucleotide primer
  primer_bind (1)..(39)
  misc_feature (33)..(39): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10583 - DNA, 38 bp, Artificial Sequence; identical to SEQ ID NO: 10569
  Pan degenerate oligonucleotide primer
  primer_bind (1)..(38)
  misc_feature (32)..(38): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10584 - DNA, 37 bp, Artificial Sequence; identical to SEQ ID NO: 10572
  Pan degenerate oligonucleotide primer
  primer_bind (1)..(37)
  misc_feature (31)..(37): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10585 - DNA, 35 bp, Artificial Sequence; identical to SEQ ID NO: 10575
  Pan degenerate oligonucleotide primer
  primer_bind (1)..(35)
  misc_feature (29)..(35): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10586 - DNA, 34 bp, Artificial Sequence; identical to SEQ ID NO: 10578
  Pan degenerate oligonucleotide primer
  primer_bind (1)..(34)
  misc_feature (28)..(34): Adaptor region of the pan degenerate antisense primer that adapts the probe-binding site downstream of codon 47 to correspond to the nucleotides in an oligonucleotide probe downstream of the discriminating single nucleotide polymorphism.

SEQ ID NO: 10587 - DNA, 51 bp, Artificial Sequence
  Pan degenerate oligonucleotide primer
  primer_bind (1)..(51)
  misc_feature (6)..(6): n is a, c, g, or t
  misc_feature (45)..(51): Adaptor region of the pan degenerate antisense primer that adapts the probe-binding site downstream of codon 47 to correspond to the nucleotides in an oligonucleotide probe downstream of the discriminating single nucleotide polymorphism.
tayddntaybtsmtcataytgyyttacyttrayaaarcctccaattccccc

SEQ ID NO: 10588 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 47 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tcataytgyyttacyttrataaarcctccaattccycctan

SEQ ID NO: 10589 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 47 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
cataytgyyttacyttrataaarcctccaattccycctan

SEQ ID NO: 10590 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 47 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ataytgyyttacyttrataaarcctccaattccycctan

SEQ ID NO: 10591 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 47 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
taytgyyttacyttrataaarcctccaattccycctan

SEQ ID NO: 10592 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 47 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ytgyyttacyttrataaarcctccaattccycctan

SEQ ID NO: 10593 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 47 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tgyyttacyttrataaarcctccaattccycctan

SEQ ID NO: 10594 - DNA, 52 bp, Artificial Sequence
  Pan degenerate oligonucleotide primer
  primer_bind (1)..(52)
  misc_feature (6)..(6): n is a, c, g, or t
  misc_feature (45)..(51): Adaptor region of the pan degenerate antisense primer that adapts the probe-binding site downstream of codon 47 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tayddntaybtsmtcataytgyyttacyttrayaaarcctccaattcccccn

SEQ ID NO: 10595 - DNA, 51 bp, Artificial Sequence
  Pan degenerate oligonucleotide primer
  primer_bind (1)..(51)
  misc_feature (9)..(9): n is a, c, g, or t
  misc_feature (45)..(51): Adaptor region of the pan degenerate antisense primer that adapts the probe-binding site downstream of codon 48 to correspond to the nucleotides in an oligonucleotide probe downstream of the discriminating single nucleotide polymorphism.
ytctayddntaybtsmtcataytgyyttacyttrayaaarcctccaattcc

SEQ ID NO: 10596 - DNA, 52 bp, Artificial Sequence
  Pan degenerate oligonucleotide primer
  primer_bind (1)..(52)
  misc_feature (9)..(9): n is a, c, g, or t
  misc_feature (45)..(51): Adaptor region of the pan degenerate antisense primer that adapts the probe-binding site downstream of codon 48 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ytctayddntaybtsmtcataytgyyttacyttrayaaarcctccaattccn

SEQ ID NO: 10597 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 50 to correspond to the nucleotides in an oligonucleotide probe downstream of the discriminating single nucleotide polymorphism.
rbtayytshtcataytgyyttacyttrataaarcctccaa

SEQ ID NO: 10598 - DNA, 40 bp, Artificial Sequence; identical to SEQ ID NO: 10597
  Pan degenerate oligonucleotide primer
  primer_bind (1)..(40)
  modified_base (4)..(4): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10599 - DNA, 40 bp, Artificial Sequence; identical to SEQ ID NO: 10597
  Pan degenerate oligonucleotide primer
  primer_bind (1)..(40)
  modified_base (3)..(3): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10600 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 50 to correspond to the nucleotides in an oligonucleotide probe downstream of the discriminating single nucleotide polymorphism.
tayytshtcataytgyyttacyttrataaarcctccaa

SEQ ID NO: 10601 - DNA, 38 bp, Artificial Sequence; identical to SEQ ID NO: 10600
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10602 - DNA, 38 bp, Artificial Sequence; identical to SEQ ID NO: 10600
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10603 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 50 to correspond to the nucleotides in an oligonucleotide probe downstream of the discriminating single nucleotide polymorphism.
ayytshtcataytgyyttacyttrataaarcctccaa

SEQ ID NO: 10604 - DNA, 37 bp, Artificial Sequence; identical to SEQ ID NO: 10603
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10605 - DNA, 37 bp, Artificial Sequence; identical to SEQ ID NO: 10603
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10606 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 50 to correspond to the nucleotides in an oligonucleotide probe downstream of the discriminating single nucleotide polymorphism.
ytshtcataytgyyttacyttrataaarcctccaa

SEQ ID NO: 10607 - DNA, 35 bp, Artificial Sequence; identical to SEQ ID NO: 10606
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10608 - DNA, 35 bp, Artificial Sequence; identical to SEQ ID NO: 10606
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10609 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 50 to correspond to the nucleotides in an oligonucleotide probe downstream of the discriminating single nucleotide polymorphism.
tshtcataytgyyttacyttrataaarcctccaa

SEQ ID NO: 10610 - DNA, 34 bp, Artificial Sequence; identical to SEQ ID NO: 10609
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10611 - DNA, 34 bp, Artificial Sequence; identical to SEQ ID NO: 10609
  Pan degenerate oligonucleotide primer
  primer_bind (1)..(34)
  modified_base (1)..(1): base is a locked nucleic acid
  modified_base (3)..(3): base is a locked nucleic acid
  modified_base (7)..(7): base is a locked nucleic acid
  misc_feature (28)..(34): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10612 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 50 to correspond to the nucleotides in an oligonucleotide probe downstream of the discriminating single nucleotide polymorphism.
htcataytgyyttacyttrataaarcctccaa

SEQ ID NO: 10613 - DNA, 32 bp, Artificial Sequence; identical to SEQ ID NO: 10612
  Pan degenerate oligonucleotide primer
  primer_bind (1)..(32)
  modified_base (1)..(1): base is a locked nucleic acid
  modified_base (5)..(5): base is a locked nucleic acid
  modified_base (7)..(7): base is a locked nucleic acid
  misc_feature (26)..(32): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10614 - DNA, 32 bp, Artificial Sequence; identical to SEQ ID NO: 10612
  Pan degenerate oligonucleotide primer
  primer_bind (1)..(32)
  modified_base (1)..(1): base is a locked nucleic acid
  modified_base (2)..(2): base is a locked nucleic acid
  modified_base (7)..(7): base is a locked nucleic acid
  misc_feature (26)..(32): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10615 - DNA, 40 bp, Artificial Sequence; identical to SEQ ID NO: 10597
  Pan degenerate oligonucleotide primer
  primer_bind (1)..(40)
  misc_feature (34)..(40): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10616 - DNA, 38 bp, Artificial Sequence; identical to SEQ ID NO: 10600
  Pan degenerate oligonucleotide primer
  primer_bind (1)..(38)
  misc_feature (32)..(38): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10617 - DNA, 37 bp, Artificial Sequence; identical to SEQ ID NO: 10603
  Pan degenerate oligonucleotide primer
  primer_bind (1)..(37)
  misc_feature (31)..(37): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10618 - DNA, 35 bp, Artificial Sequence; identical to SEQ ID NO: 10606
  Pan degenerate oligonucleotide primer
  primer_bind (1)..(35)
  misc_feature (29)..(35): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10619 - DNA, 34 bp, Artificial Sequence; identical to SEQ ID NO: 10609
  Pan degenerate oligonucleotide primer
  primer_bind (1)..(34)
  misc_feature (28)..(34): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10620 - DNA, 32 bp, Artificial Sequence; identical to SEQ ID NO: 10612
  Pan degenerate oligonucleotide primer
  primer_bind (1)..(32)
  misc_feature (26)..(32): Adaptor region of the pan degenerate antisense primer that adapts the probe-binding site downstream of codon 50 to correspond to the nucleotides in an oligonucleotide probe downstream of the discriminating single nucleotide polymorphism.

SEQ ID NO: 10621 - DNA, 51 bp, Artificial Sequence
  Pan degenerate oligonucleotide primer
  primer_bind (1)..(51)
  misc_feature (15)..(15): n is a, c, g, or t
  misc_feature (45)..(51): Adaptor region of the pan degenerate antisense primer that adapts the probe-binding site downstream of codon 50 to correspond to the nucleotides in an oligonucleotide probe downstream of the discriminating single nucleotide polymorphism.
rcaratytctayddntaybtsmtcataytgyyttacyttrayaaaacctcc

SEQ ID NO: 10622 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 50 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
rbtayytshtcataytgyyttacyttrataaarcctccaan

SEQ ID NO: 10623 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 50 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
tayytshtcataytgyyttacyttrataaarcctccaan

SEQ ID NO: 10624 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 50 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ayytshtcataytgyyttacyttrataaarcctccaan

SEQ ID NO: 10625 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 50 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ytshtcataytgyyttacyttrataaarcctccaan

SEQ ID NO: 10626 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 50 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tshtcataytgyyttacyttrataaarcctccaan

SEQ ID NO: 10627 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 50 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
htcataytgyyttacyttrataaarcctccaan

SEQ ID NO: 10628 - DNA, 52 bp, Artificial Sequence
  Pan degenerate oligonucleotide primer
  primer_bind (1)..(52)
  misc_feature (15)..(15): n is a, c, g, or t
  misc_feature (45)..(51): Adaptor region of the pan degenerate antisense primer that adapts the probe-binding site downstream of codon 50 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rcaratytctayddntaybtsmtcataytgyyttacyttrayaaaacctccn

SEQ ID NO: 10629 - DNA, 40 bp, Artificial Sequence
  Pan degenerate oligonucleotide primer
  primer_bind (1)..(40)
  modified_base (2)..(2): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.
aratttctatrrbtayytshtcataytgyyttacyttrat

SEQ ID NO: 10630 - DNA, 40 bp, Artificial Sequence; identical to SEQ ID NO: 10629
  Pan degenerate oligonucleotide primer
  primer_bind (1)..(40)
  modified_base (2)..(2): base is a locked nucleic acid
  modified_base (7)..(7): base is a locked nucleic acid
  modified_base (8)..(8): base is a locked nucleic acid
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10631 - DNA, 40 bp, Artificial Sequence; identical to SEQ ID NO: 10629
  Pan degenerate oligonucleotide primer
  primer_bind (1)..(40)
  modified_base (2)..(2): base is a locked nucleic acid
  modified_base (4)..(4): base is a locked nucleic acid
  modified_base (8)..(8): base is a locked nucleic acid
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10632 - DNA, 37 bp, Artificial Sequence
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate antisense primer that adapts the probe-binding site downstream of codon 53 to correspond to the nucleotides in an oligonucleotide probe downstream of the discriminating single nucleotide polymorphism.
tttctatrrbtayytshtcataytgyyttacyttrat

SEQ ID NO: 10633 - DNA, 37 bp, Artificial Sequence; identical to SEQ ID NO: 10632
  Pan degenerate oligonucleotide primer
  primer_bind (1)..(37)
  modified_base (1)..(1): base is a locked nucleic acid
  modified_base (5)..(5): base is a locked nucleic acid
  modified_base (7)..(7): base is a locked nucleic acid
  misc_feature (31)..(37): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10634 - DNA, 37 bp, Artificial Sequence; identical to SEQ ID NO: 10632
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10635 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate antisense primer that adapts the probe-binding site downstream of codon 53 to correspond to the nucleotides in an oligonucleotide probe downstream of the discriminating single nucleotide polymorphism.
ctatrrbtayytshtcataytgyyttacyttrat

SEQ ID NO: 10636 - DNA, 34 bp, Artificial Sequence; identical to SEQ ID NO: 10635
  Pan degenerate oligonucleotide primer
  primer_bind (1)..(34)
  modified_base (1)..(1): base is a locked nucleic acid
  modified_base (4)..(4): base is a locked nucleic acid
  modified_base (8)..(8): base is a locked nucleic acid
  misc_feature (28)..(34): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10637 - DNA, 34 bp, Artificial Sequence; identical to SEQ ID NO: 10635
  Pan degenerate oligonucleotide primer
  primer_bind (1)..(34)
  modified_base (1)..(1): base is a locked nucleic acid
  modified_base (2)..(2): base is a locked nucleic acid
  modified_base (8)..(8): base is a locked nucleic acid
  misc_feature (28)..(34): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10638 - DNA, 33 bp, Artificial Sequence
  Pan degenerate oligonucleotide primer
  primer_bind (1)..(33)
  modified_base (1)..(1): base is a locked nucleic acid
  modified_base (3)..(3): base is a locked nucleic acid
  modified_base (7)..(7): base is a locked nucleic acid
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.
tatrrbtayytshtcataytgyyttacyttrat

SEQ ID NO: 10639 - DNA, 33 bp, Artificial Sequence; identical to SEQ ID NO: 10638
  Pan degenerate oligonucleotide primer
  primer_bind (1)..(33)
  modified_base (1)..(1): base is a locked nucleic acid
  modified_base (7)..(7): base is a locked nucleic acid
  modified_base (9)..(9): base is a locked nucleic acid
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10640 - DNA, 33 bp, Artificial Sequence; identical to SEQ ID NO: 10638
  Pan degenerate oligonucleotide primer
  primer_bind (1)..(33)
  modified_base (1)..(1): base is a locked nucleic acid
  modified_base (3)..(3): base is a locked nucleic acid
  modified_base (9)..(9): base is a locked nucleic acid
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10641 - DNA, 31 bp, Artificial Sequence
  Pan degenerate oligonucleotide primer
  primer_bind (1)..(31)
  modified_base (1)..(1): base is a locked nucleic acid
  modified_base (5)..(5): base is a locked nucleic acid
  modified_base (7)..(7): base is a locked nucleic acid
  misc_feature (25)..(31): Adaptor region of the pan degenerate antisense primer that adapts the probe-binding site downstream of codon 53 to correspond to the nucleotides in an oligonucleotide probe downstream of the discriminating single nucleotide polymorphism.
trrbtayytshtcataytgyyttacyttrat

SEQ ID NO: 10642 - DNA, 31 bp, Artificial Sequence; identical to SEQ ID NO: 10641
  Pan degenerate oligonucleotide primer
  primer_bind (1)..(31)
  modified_base (1)..(1): base is a locked nucleic acid
  modified_base (7)..(7): base is a locked nucleic acid
  modified_base (8)..(8): base is a locked nucleic acid
  misc_feature (25)..(31): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10643 - DNA, 31 bp, Artificial Sequence; identical to SEQ ID NO: 10641
  Pan degenerate oligonucleotide primer
  primer_bind (1)..(31)
  modified_base (1)..(1): base is a locked nucleic acid
  modified_base (5)..(5): base is a locked nucleic acid
  modified_base (8)..(8): base is a locked nucleic acid
  misc_feature (25)..(31): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10644 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (4)..(4): base is a locked nucleic acid
  misc_feature (21)..(27): Adaptor region of the pan degenerate antisense primer that adapts the probe-binding site downstream of codon 53 to correspond to the nucleotides in an oligonucleotide probe downstream of the discriminating single nucleotide polymorphism.
tayytshtcataytgyyttacyttrat

SEQ ID NO: 10645 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (7)..(7): base is a locked nucleic acid
  misc_feature (21)..(27): Adaptor region of the pan degenerate antisense primer that adapts the probe-binding site downstream of codon 53 to correspond to the nucleotides in an oligonucleotide probe downstream of the discriminating single nucleotide polymorphism.
tayytshtcataytgyyttacyttrat

SEQ ID NO: 10646 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (7)..(7): base is a locked nucleic acid
  misc_feature (21)..(27): Adaptor region of the pan degenerate antisense primer that adapts the probe-binding site downstream of codon 53 to correspond to the nucleotides in an oligonucleotide probe downstream of the discriminating single nucleotide polymorphism.
tayytshtcataytgyyttacyttrat

SEQ ID NO: 10647 - DNA, 40 bp, Artificial Sequence
  Pan degenerate oligonucleotide primer
  primer_bind (1)..(40)
  modified_base (3)..(3): base is a locked nucleic acid
  modified_base (5)..(5): base is a locked nucleic acid
  modified_base (8)..(8): base is a locked nucleic acid
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.
ratttctatrrbtayytshtcataytgyyttacyttrata

SEQ ID NO: 10648 - DNA, 40 bp, Artificial Sequence; identical to SEQ ID NO: 10647
  Pan degenerate oligonucleotide primer
  primer_bind (1)..(40)
  modified_base (3)..(3): base is a locked nucleic acid
  modified_base (8)..(8): base is a locked nucleic acid
  modified_base (9)..(9): base is a locked nucleic acid
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10649 - DNA, 40 bp, Artificial Sequence; identical to SEQ ID NO: 10647
  Pan degenerate oligonucleotide primer
  primer_bind (1)..(40)
  modified_base (3)..(3): base is a locked nucleic acid
  modified_base (5)..(5): base is a locked nucleic acid
  modified_base (9)..(9): base is a locked nucleic acid
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10650 - DNA, 36 bp, Artificial Sequence
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate antisense primer that adapts the probe-binding site downstream of codon 53 to correspond to the nucleotides in an oligonucleotide probe downstream of the discriminating single nucleotide polymorphism.
tctatrrbtayytshtcataytgyyttacyttrata

SEQ ID NO: 10651 - DNA, 36 bp, Artificial Sequence; identical to SEQ ID NO: 10650
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (30)..(36): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10652 - DNA, 36 bp, Artificial Sequence; identical to SEQ ID NO: 10650
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10653 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.
atrrbtayytshtcataytgyyttacyttrata

SEQ ID NO: 10654 - DNA, 33 bp, Artificial Sequence; identical to SEQ ID NO: 10653
  Pan degenerate oligonucleotide primer
  primer_bind (1)..(33)
  modified_base (1)..(1): base is a locked nucleic acid
  modified_base (4)..(4): base is a locked nucleic acid
  modified_base (8)..(8): base is a locked nucleic acid
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10655 - DNA, 33 bp, Artificial Sequence; identical to SEQ ID NO: 10653
  Pan degenerate oligonucleotide primer
  primer_bind (1)..(33)
  modified_base (1)..(1): base is a locked nucleic acid
  modified_base (2)..(2): base is a locked nucleic acid
  modified_base (8)..(8): base is a locked nucleic acid
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10656 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (26)..(32): Adaptor region of the pan degenerate antisense primer that adapts the probe-binding site downstream of codon 53 to correspond to the nucleotides in an oligonucleotide probe downstream of the discriminating single nucleotide polymorphism.
trrbtayytshtcataytgyyttacyttrata

SEQ ID NO: 10657 - DNA, 32 bp, Artificial Sequence; identical to SEQ ID NO: 10656
  Pan degenerate oligonucleotide primer
  primer_bind (1)..(32)
  modified_base (1)..(1): base is a locked nucleic acid
  modified_base (7)..(7): base is a locked nucleic acid
  modified_base (9)..(9): base is a locked nucleic acid
  misc_feature (26)..(32): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10658 - DNA, 32 bp, Artificial Sequence; identical to SEQ ID NO: 10656
  Pan degenerate oligonucleotide primer
  primer_bind (1)..(32)
  modified_base (1)..(1): base is a locked nucleic acid
  modified_base (3)..(3): base is a locked nucleic acid
  modified_base (9)..(9): base is a locked nucleic acid
  misc_feature (26)..(32): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10659 - DNA, 30 bp, Artificial Sequence
  Pan degenerate oligonucleotide primer
  primer_bind (1)..(30)
  modified_base (1)..(1): base is a locked nucleic acid
  modified_base (5)..(5): base is a locked nucleic acid
  modified_base (7)..(7): base is a locked nucleic acid
  misc_feature (24)..(30): Adaptor region of the pan degenerate antisense primer that adapts the probe-binding site downstream of codon 53 to correspond to the nucleotides in an oligonucleotide probe downstream of the discriminating single nucleotide polymorphism.
rbtayytshtcataytgyyttacyttrata

SEQ ID NO: 10660 - DNA, 30 bp, Artificial Sequence; identical to SEQ ID NO: 10659
  Pan degenerate oligonucleotide primer
  primer_bind (1)..(30)
  modified_base (1)..(1): base is a locked nucleic acid
  modified_base (7)..(7): base is a locked nucleic acid
  modified_base (8)..(8): base is a locked nucleic acid
  misc_feature (24)..(30): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10661 - DNA, 30 bp, Artificial Sequence; identical to SEQ ID NO: 10659
  Pan degenerate oligonucleotide primer
  primer_bind (1)..(30)
  modified_base (1)..(1): base is a locked nucleic acid
  modified_base (5)..(5): base is a locked nucleic acid
  modified_base (8)..(8): base is a locked nucleic acid
  misc_feature (24)..(30): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10662 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate antisense primer that adapts the probe-binding site downstream of codon 53 to correspond to the nucleotides in an oligonucleotide probe downstream of the discriminating single nucleotide polymorphism.
yytshtcataytgyyttacyttrata

SEQ ID NO: 10663 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (7)..(7): base is a locked nucleic acid
  misc_feature (20)..(26): Adaptor region of the pan degenerate antisense primer that adapts the probe-binding site downstream of codon 53 to correspond to the nucleotides in an oligonucleotide probe downstream of the discriminating single nucleotide polymorphism.
yytshtcataytgyyttacyttrata

SEQ ID NO: 10664 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (7)..(7): base is a locked nucleic acid
  misc_feature (20)..(26): Adaptor region of the pan degenerate antisense primer that adapts the probe-binding site downstream of codon 53 to correspond to the nucleotides in an oligonucleotide probe downstream of the discriminating single nucleotide polymorphism.
yytshtcataytgyyttacyttrata

SEQ ID NO: 10665 - DNA, 40 bp, Artificial Sequence; identical to SEQ ID NO: 10629
  Pan degenerate oligonucleotide primer
  primer_bind (1)..(40)
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10666 - DNA, 37 bp, Artificial Sequence; identical to SEQ ID NO: 10632
  Pan degenerate oligonucleotide primer
  primer_bind (1)..(37)
  misc_feature (31)..(37): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10667 - DNA, 34 bp, Artificial Sequence; identical to SEQ ID NO: 10635
  Pan degenerate oligonucleotide primer
  primer_bind (1)..(34)
  misc_feature (28)..(34): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10668 - DNA, 33 bp, Artificial Sequence; identical to SEQ ID NO: 10638
  Pan degenerate oligonucleotide primer
  primer_bind (1)..(33)
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10669 - DNA, 31 bp, Artificial Sequence; identical to SEQ ID NO: 10641
  Pan degenerate oligonucleotide primer
  primer_bind (1)..(31)
  misc_feature (25)..(31): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10670 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 53 to correspond to the nucleotides in an oligonucleotide probe downstream of the discriminating single nucleotide polymorphism.
tayytshtcataytgyyttacyttrat

SEQ ID NO: 10671 - DNA, 40 bp, Artificial Sequence; identical to SEQ ID NO: 10647
  Pan degenerate oligonucleotide primer
  primer_bind (1)..(40)
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10672 - DNA, 36 bp, Artificial Sequence; identical to SEQ ID NO: 10650
  Pan degenerate oligonucleotide primer
  primer_bind (1)..(36)
  misc_feature (30)..(36): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10673 - DNA, 33 bp, Artificial Sequence; identical to SEQ ID NO: 10653
  Pan degenerate oligonucleotide primer
  primer_bind (1)..(33)
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10674 - DNA, 32 bp, Artificial Sequence; identical to SEQ ID NO: 10656
  Pan degenerate oligonucleotide primer
  primer_bind (1)..(32)
  misc_feature (26)..(32): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10675 - DNA, 30 bp, Artificial Sequence; identical to SEQ ID NO: 10659
  Pan degenerate oligonucleotide primer
  primer_bind (1)..(30)
  misc_feature (24)..(30): Adaptor region of the pan degenerate antisense primer that adapts the probe-binding site downstream of codon 53 to correspond to the nucleotides in an oligonucleotide probe downstream of the discriminating single nucleotide polymorphism.

SEQ ID NO: 10676 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 53 to correspond to the nucleotides in an oligonucleotide probe downstream of the discriminating single nucleotide polymorphism.
yytshtcataytgyyttacyttrata

SEQ ID NO: 10677 - DNA, 51 bp, Artificial Sequence
  Pan degenerate oligonucleotide primer
  primer_bind (1)..(51)
  misc_feature (24)..(24): n is a, c, g, or t
  misc_feature (45)..(51): Adaptor region of the pan degenerate antisense primer that adapts the probe-binding site downstream of codon 53 to correspond to the nucleotides in an oligonucleotide probe downstream of the discriminating single nucleotide polymorphism.
yytdtkyccrcaratytctayddntaybtsmtcataytgyyttactttgat

SEQ ID NO: 10678 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
aratttctatrrbtayytshtcataytgyyttacyttratn

SEQ ID NO: 10679 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
tttctatrrbtayytshtcataytgyyttacyttratn

SEQ ID NO: 10680 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ctatrrbtayytshtcataytgyyttacyttratn

SEQ ID NO: 10681 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tatrrbtayytshtcataytgyyttacyttratn

SEQ ID NO: 10682 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
trrbtayytshtcataytgyyttacyttratn

SEQ ID NO: 10683 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
tayytshtcataytgyyttacyttratn

SEQ ID NO: 10684 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ratttctatrrbtayytshtcataytgyyttacyttratan

SEQ ID NO: 10685 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
tctatrrbtayytshtcataytgyyttacyttratan

SEQ ID NO: 10686 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
atrrbtayytshtcataytgyyttacyttratan

SEQ ID NO: 10687 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
trrbtayytshtcataytgyyttacyttratan

SEQ ID NO: 10688 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
rbtayytshtcataytgyyttacyttratan

SEQ ID NO: 10689 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
yytshtcataytgyyttacyttratan

SEQ ID NO: 10690 - DNA, 52 bp, Artificial Sequence
  Pan degenerate oligonucleotide primer
  primer_bind (1)..(52)
  misc_feature (24)..(24): n is a, c, g, or t
  misc_feature (45)..(51): Adaptor region of the pan degenerate antisense primer that adapts the probe-binding site downstream of codon 53 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
yytdtkyccrcaratytctayddntaybtsmtcataytgyyttactttgatn

SEQ ID NO: 10691 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.
cacaratttctatrrbtayytshtcataytgyyttacytt

SEQ ID NO: 10692 - DNA, 40 bp, Artificial Sequence; identical to SEQ ID NO: 10691
  Pan degenerate oligonucleotide primer
  primer_bind (1)..(40)
  modified_base (1)..(1): base is a locked nucleic acid
  modified_base (5)..(5): base is a locked nucleic acid
  modified_base (7)..(7): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10693 - DNA, 40 bp, Artificial Sequence; identical to SEQ ID NO: 10691
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10694 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate antisense primer that adapts the probe-binding site downstream of codon 54 to correspond to the nucleotides in an oligonucleotide probe downstream of the discriminating single nucleotide polymorphism.
aratttctatrrbtayytshtcataytgyyttacytt

SEQ ID NO: 10695 - DNA, 37 bp, Artificial Sequence; identical to SEQ ID NO: 10694
  Pan degenerate oligonucleotide primer
  primer_bind (1)..(37)
  modified_base (1)..(1): base is a locked nucleic acid
  modified_base (4)..(4): base is a locked nucleic acid
  modified_base (8)..(8): base is a locked nucleic acid
  misc_feature (31)..(37): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10696 - DNA, 37 bp, Artificial Sequence; identical to SEQ ID NO: 10694
  Pan degenerate oligonucleotide primer
  primer_bind (1)..(37)
  modified_base (1)..(1): base is a locked nucleic acid
  modified_base (2)..(2): base is a locked nucleic acid
  modified_base (8)..(8): base is a locked nucleic acid
  misc_feature (31)..(37): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10697 - DNA, 36 bp, Artificial Sequence
  Pan degenerate oligonucleotide primer
  primer_bind (1)..(36)
  modified_base (1)..(1): base is a locked nucleic acid
  modified_base (3)..(3): base is a locked nucleic acid
  modified_base (7)..(7): base is a locked nucleic acid
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.
ratttctatrrbtayytshtcataytgyyttacytt

SEQ ID NO: 10698 - DNA, 36 bp, Artificial Sequence; identical to SEQ ID NO: 10697
  Pan degenerate oligonucleotide primer
  primer_bind (1)..(36)
  modified_base (1)..(1): base is a locked nucleic acid
  modified_base (7)..(7): base is a locked nucleic acid
  modified_base (9)..(9): base is a locked nucleic acid
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10699 - DNA, 36 bp, Artificial Sequence; identical to SEQ ID NO: 10697
  Pan degenerate oligonucleotide primer
  primer_bind (1)..(36)
  modified_base (1)..(1): base is a locked nucleic acid
  modified_base (3)..(3): base is a locked nucleic acid
  modified_base (9)..(9): base is a locked nucleic acid
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10700 - DNA, 34 bp, Artificial Sequence
  Pan degenerate oligonucleotide primer
  primer_bind (1)..(34)
  modified_base (1)..(1): base is a locked nucleic acid
  modified_base (5)..(5): base is a locked nucleic acid
  modified_base (7)..(7): base is a locked nucleic acid
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.
tttctatrrbtayytshtcataytgyyttacytt

SEQ ID NO: 10701 - DNA, 34 bp, Artificial Sequence; identical to SEQ ID NO: 10700
  Pan degenerate oligonucleotide primer
  primer_bind (1)..(34)
  modified_base (1)..(1): base is a locked nucleic acid
  modified_base (7)..(7): base is a locked nucleic acid
  modified_base (8)..(8): base is a locked nucleic acid
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10702 - DNA, 34 bp, Artificial Sequence; identical to SEQ ID NO: 10700
  Pan degenerate oligonucleotide primer
  primer_bind (1)..(34)
  modified_base (1)..(1): base is a locked nucleic acid
  modified_base (5)..(5): base is a locked nucleic acid
  modified_base (8)..(8): base is a locked nucleic acid
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10703 - DNA, 30 bp, Artificial Sequence
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate antisense primer that adapts the probe-binding site downstream of codon 54 to correspond to the nucleotides in an oligonucleotide probe downstream of the discriminating single nucleotide polymorphism.
tatrrbtayytshtcataytgyyttacytt

SEQ ID NO: 10704 - DNA, 30 bp, Artificial Sequence; identical to SEQ ID NO: 10703
  Pan degenerate oligonucleotide primer
  primer_bind (1)..(30)
  modified_base (1)..(1): base is a locked nucleic acid
  modified_base (4)..(4): base is a locked nucleic acid
  modified_base (7)..(7): base is a locked nucleic acid
  misc_feature (24)..(30): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10705 - DNA, 30 bp, Artificial Sequence; identical to SEQ ID NO: 10703
  Pan degenerate oligonucleotide primer
  primer_bind (1)..(30)
  modified_base (1)..(1): base is a locked nucleic acid
  modified_base (3)..(3): base is a locked nucleic acid
  modified_base (7)..(7): base is a locked nucleic acid
  misc_feature (24)..(30): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10706 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (5)..(5): base is a locked nucleic acid
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacytt

SEQ ID NO: 10707 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (8)..(8): base is a locked nucleic acid
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacytt

SEQ ID NO: 10708 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (8)..(8): base is a locked nucleic acid
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacytt

SEQ ID NO: 10709 - DNA, 40 bp, Artificial Sequence
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.
acaratttctatrrbtayytshtcataytgyyttacyttr

SEQ ID NO: 10710 - DNA, 40 bp, Artificial Sequence; identical to SEQ ID NO: 10709
  Pan degenerate oligonucleotide primer
  primer_bind (1)..(40)
  modified_base (2)..(2): base is a locked nucleic acid
  modified_base (6)..(6): base is a locked nucleic acid
  modified_base (8)..(8): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10711 - DNA, 40 bp, Artificial Sequence; identical to SEQ ID NO: 10709
  Pan degenerate oligonucleotide primer
  primer_bind (1)..(40)
  modified_base (2)..(2): base is a locked nucleic acid
  modified_base (5)..(5): base is a locked nucleic acid
  modified_base (8)..(8): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10712 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.
atttctatrrbtayytshtcataytgyyttacyttr

SEQ ID NO: 10713 - DNA, 36 bp, Artificial Sequence; identical to SEQ ID NO: 10712
  Pan degenerate oligonucleotide primer
  primer_bind (1)..(36)
  modified_base (1)..(1): base is a locked nucleic acid
  modified_base (4)..(4): base is a locked nucleic acid
  modified_base (8)..(8): base is a locked nucleic acid
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10714 - DNA, 36 bp, Artificial Sequence; identical to SEQ ID NO: 10712
  Pan degenerate oligonucleotide primer
  primer_bind (1)..(36)
  modified_base (1)..(1): base is a locked nucleic acid
  modified_base (2)..(2): base is a locked nucleic acid
  modified_base (8)..(8): base is a locked nucleic acid
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10715 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.
tttctatrrbtayytshtcataytgyyttacyttr

SEQ ID NO: 10716 - DNA, 35 bp, Artificial Sequence; identical to SEQ ID NO: 10715
  Pan degenerate oligonucleotide primer
  primer_bind (1)..(35)
  modified_base (1)..(1): base is a locked nucleic acid
  modified_base (7)..(7): base is a locked nucleic acid
  modified_base (9)..(9): base is a locked nucleic acid
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10717 - DNA, 35 bp, Artificial Sequence; identical to SEQ ID NO: 10715
  Pan degenerate oligonucleotide primer
  primer_bind (1)..(35)
  modified_base (1)..(1): base is a locked nucleic acid
  modified_base (3)..(3): base is a locked nucleic acid
  modified_base (9)..(9): base is a locked nucleic acid
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10718 - DNA, 33 bp, Artificial Sequence
  Pan degenerate oligonucleotide primer
  primer_bind (1)..(33)
  modified_base (1)..(1): base is a locked nucleic acid
  modified_base (5)..(5): base is a locked nucleic acid
  modified_base (7)..(7): base is a locked nucleic acid
  misc_feature (27)..(33): Adaptor region of the pan degenerate antisense primer that adapts the probe-binding site downstream of codon 54 to correspond to the nucleotides in an oligonucleotide probe downstream of the discriminating single nucleotide polymorphism.
tctatrrbtayytshtcataytgyyttacyttr

SEQ ID NO: 10719 - DNA, 33 bp, Artificial Sequence; identical to SEQ ID NO: 10718
  Pan degenerate oligonucleotide primer
  primer_bind (1)..(33)
  modified_base (1)..(1): base is a locked nucleic acid
  modified_base (7)..(7): base is a locked nucleic acid
  modified_base (8)..(8): base is a locked nucleic acid
  misc_feature (27)..(33): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10720 - DNA, 33 bp, Artificial Sequence; identical to SEQ ID NO: 10718
  Pan degenerate oligonucleotide primer
  primer_bind (1)..(33)
  modified_base (1)..(1): base is a locked nucleic acid
  modified_base (5)..(5): base is a locked nucleic acid
  modified_base (8)..(8): base is a locked nucleic acid
  misc_feature (27)..(33): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10721 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacyttr

SEQ ID NO: 10722 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacyttr

SEQ ID NO: 10723 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (7)..(7): base is a locked nucleic acid
  misc_feature (23)..(29): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacyttr

SEQ ID NO: 10724 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttr

SEQ ID NO: 10725 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (8)..(8): base is a locked nucleic acid
  misc_feature (21)..(27): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttr

SEQ ID NO: 10726 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (8)..(8): base is a locked nucleic acid
  misc_feature (21)..(27): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttr

SEQ ID NO: 10727 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.
caratttctatrrbtayytshtcataytgyyttacyttra

SEQ ID NO: 10728 - DNA, 40 bp, Artificial Sequence; identical to SEQ ID NO: 10727
  Pan degenerate oligonucleotide primer
  primer_bind (1)..(40)
  modified_base (6)..(6): base is a locked nucleic acid
  modified_base (7)..(7): base is a locked nucleic acid
  modified_base (9)..(9): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10729 - DNA, 40 bp, Artificial Sequence; identical to SEQ ID NO: 10727
  Pan degenerate oligonucleotide primer
  primer_bind (1)..(40)
  modified_base (3)..(3): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10730 - DNA, 38 bp, Artificial Sequence
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 54 to correspond to the nucleotides in an oligonucleotide probe downstream of the discriminating single nucleotide polymorphism.
ratttctatrrbtayytshtcataytgyyttacyttra

SEQ ID NO: 10731 - DNA, 38 bp, Artificial Sequence; identical to SEQ ID NO: 10730
  Pan degenerate oligonucleotide primer
  primer_bind (1)..(38)
  modified_base (1)..(1): base is a locked nucleic acid
  modified_base (5)..(5): base is a locked nucleic acid
  modified_base (7)..(7): base is a locked nucleic acid
  misc_feature (32)..(38): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10732 - DNA, 38 bp, Artificial Sequence; identical to SEQ ID NO: 10730
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10733 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.
ttctatrrbtayytshtcataytgyyttacyttra

SEQ ID NO: 10734 - DNA, 35 bp, Artificial Sequence; identical to SEQ ID NO: 10733
  Pan degenerate oligonucleotide primer
  primer_bind (1)..(35)
  modified_base (1)..(1): base is a locked nucleic acid
  modified_base (4)..(4): base is a locked nucleic acid
  modified_base (8)..(8): base is a locked nucleic acid
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10735 - DNA, 35 bp, Artificial Sequence; identical to SEQ ID NO: 10733
  Pan degenerate oligonucleotide primer
  primer_bind (1)..(35)
  modified_base (1)..(1): base is a locked nucleic acid
  modified_base (2)..(2): base is a locked nucleic acid
  modified_base (8)..(8): base is a locked nucleic acid
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10736 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (7)..(7): base is a locked nucleic acid
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.
tctatrrbtayytshtcataytgyyttacyttra

SEQ ID NO: 10737 - DNA, 34 bp, Artificial Sequence; identical to SEQ ID NO: 10736
  Pan degenerate oligonucleotide primer
  primer_bind (1)..(34)
  modified_base (1)..(1): base is a locked nucleic acid
  modified_base (7)..(7): base is a locked nucleic acid
  modified_base (9)..(9): base is a locked nucleic acid
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10738 - DNA, 34 bp, Artificial Sequence; identical to SEQ ID NO: 10736
  Pan degenerate oligonucleotide primer
  primer_bind (1)..(34)
  modified_base (1)..(1): base is a locked nucleic acid
  modified_base (3)..(3): base is a locked nucleic acid
  modified_base (9)..(9): base is a locked nucleic acid
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10739 - DNA, 32 bp, Artificial Sequence
  Pan degenerate oligonucleotide primer
  primer_bind (1)..(32)
  modified_base (1)..(1): base is a locked nucleic acid
  modified_base (5)..(5): base is a locked nucleic acid
  modified_base (7)..(7): base is a locked nucleic acid
  misc_feature (26)..(32): Adaptor region of the pan degenerate antisense primer that adapts the probe-binding site downstream of codon 54 to correspond to the nucleotides in an oligonucleotide probe downstream of the discriminating single nucleotide polymorphism.
tatrrbtayytshtcataytgyyttacyttra

SEQ ID NO: 10740 - DNA, 32 bp, Artificial Sequence; identical to SEQ ID NO: 10739
  Pan degenerate oligonucleotide primer
  primer_bind (1)..(32)
  modified_base (1)..(1): base is a locked nucleic acid
  modified_base (7)..(7): base is a locked nucleic acid
  modified_base (8)..(8): base is a locked nucleic acid
  misc_feature (26)..(32): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10741 - DNA, 32 bp, Artificial Sequence; identical to SEQ ID NO: 10739
  Pan degenerate oligonucleotide primer
  primer_bind (1)..(32)
  modified_base (1)..(1): base is a locked nucleic acid
  modified_base (5)..(5): base is a locked nucleic acid
  modified_base (8)..(8): base is a locked nucleic acid
  misc_feature (26)..(32): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10742 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttra

SEQ ID NO: 10743 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttra

SEQ ID NO: 10744 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (7)..(7): base is a locked nucleic acid
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttra

SEQ ID NO: 10745 - DNA, 40 bp, Artificial Sequence; identical to SEQ ID NO: 10691
  Pan degenerate oligonucleotide primer
  primer_bind (1)..(40)
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10746 - DNA, 37 bp, Artificial Sequence; identical to SEQ ID NO: 10694
  Pan degenerate oligonucleotide primer
  primer_bind (1)..(37)
  misc_feature (31)..(37): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10747 - DNA, 36 bp, Artificial Sequence; identical to SEQ ID NO: 10697
  Pan degenerate oligonucleotide primer
  primer_bind (1)..(36)
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10748 - DNA, 34 bp, Artificial Sequence; identical to SEQ ID NO: 10700
  Pan degenerate oligonucleotide primer
  primer_bind (1)..(34)
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10749 - DNA, 30 bp, Artificial Sequence; identical to SEQ ID NO: 10703
  Pan degenerate oligonucleotide primer
  primer_bind (1)..(30)
  misc_feature (24)..(30): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10750 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacytt

SEQ ID NO: 10751 - DNA, 40 bp, Artificial Sequence; identical to SEQ ID NO: 10709
  Pan degenerate oligonucleotide primer
  primer_bind (1)..(40)
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10752 - DNA, 36 bp, Artificial Sequence; identical to SEQ ID NO: 10712
  Pan degenerate oligonucleotide primer
  primer_bind (1)..(36)
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10753 - DNA, 35 bp, Artificial Sequence; identical to SEQ ID NO: 10715
  Pan degenerate oligonucleotide primer
  primer_bind (1)..(35)
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10754 - DNA, 33 bp, Artificial Sequence; identical to SEQ ID NO: 10718
  Pan degenerate oligonucleotide primer
  primer_bind (1)..(33)
  misc_feature (27)..(33): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10755 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 54 to correspond to the nucleotides in an oligonucleotide probe downstream of the discriminating single nucleotide polymorphism.
trrbtayytshtcataytgyyttacyttr

SEQ ID NO: 10756 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttr

SEQ ID NO: 10757 - DNA, 40 bp, Artificial Sequence; identical to SEQ ID NO: 10727
  Pan degenerate oligonucleotide primer
  primer_bind (1)..(40)
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10758 - DNA, 38 bp, Artificial Sequence; identical to SEQ ID NO: 10730
  Pan degenerate oligonucleotide primer
  primer_bind (1)..(38)
  misc_feature (32)..(38): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10759 - DNA, 35 bp, Artificial Sequence; identical to SEQ ID NO: 10733
  Pan degenerate oligonucleotide primer
  primer_bind (1)..(35)
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10760 - DNA, 34 bp, Artificial Sequence; identical to SEQ ID NO: 10736
  Pan degenerate oligonucleotide primer
  primer_bind (1)..(34)
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10761 - DNA, 32 bp, Artificial Sequence; identical to SEQ ID NO: 10739
  Pan degenerate oligonucleotide primer
  primer_bind (1)..(32)
  misc_feature (26)..(32): Adaptor region of the pan degenerate antisense primer that adapts the probe-binding site downstream of codon 54 to correspond to the nucleotides in an oligonucleotide probe downstream of the discriminating single nucleotide polymorphism.

SEQ ID NO: 10762 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
rbtayytshtcataytgyyttacyttra

SEQ ID NO: 10763 - DNA, 51 bp, Artificial Sequence
  Pan degenerate oligonucleotide primer
  primer_bind (1)..(51)
  misc_feature (27)..(27): n is a, c, g, or t
  misc_feature (45)..(51): Adaptor region of the pan degenerate antisense primer that adapts the probe-binding site downstream of codon 54 to correspond to the nucleotides in an oligonucleotide probe downstream of the discriminating single nucleotide polymorphism.
rryyytdtkyccrcaratytctayddntaybtsmtcataytgyyttacttt

SEQ ID NO: 10764 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
cacaratttctatrrbtayytshtcataytgyyttacyttn

SEQ ID NO: 10765 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
aratttctatrrbtayytshtcataytgyyttacyttn

SEQ ID NO: 10766 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
ratttctatrrbtayytshtcataytgyyttacyttn

SEQ ID NO: 10767 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tttctatrrbtayytshtcataytgyyttacyttn

SEQ ID NO: 10768 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tatrrbtayytshtcataytgyyttacyttn

SEQ ID NO: 10769 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
trrbtayytshtcataytgyyttacyttn

SEQ ID NO: 10770 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
acaratttctatrrbtayytshtcataytgyyttacyttrn

SEQ ID NO: 10771 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
atttctatrrbtayytshtcataytgyyttacyttrn

SEQ ID NO: 10772 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
tttctatrrbtayytshtcataytgyyttacyttrn

SEQ ID NO: 10773 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tctatrrbtayytshtcataytgyyttacyttrn

SEQ ID NO: 10774 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
trrbtayytshtcataytgyyttacyttrn

SEQ ID NO: 10775 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
rbtayytshtcataytgyyttacyttrn

SEQ ID NO: 10776 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
caratttctatrrbtayytshtcataytgyyttacyttran

SEQ ID NO: 10777 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ratttctatrrbtayytshtcataytgyyttacyttran

SEQ ID NO: 10778 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ttctatrrbtayytshtcataytgyyttacyttran

SEQ ID NO: 10779 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tctatrrbtayytshtcataytgyyttacyttran

SEQ ID NO: 10780 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tatrrbtayytshtcataytgyyttacyttran

SEQ ID NO: 10781 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
rbtayytshtcataytgyyttacyttran

SEQ ID NO: 10782 - DNA, 52 bp, Artificial Sequence
  Pan degenerate oligonucleotide primer
  primer_bind (1)..(52)
  misc_feature (27)..(27): n is a, c, g, or t
  misc_feature (45)..(51): Adaptor region of the pan degenerate antisense primer that adapts the probe-binding site downstream of codon 54 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rryyytdtkyccrcaratytctayddntaybtsmtcataytgyyttactttn

SEQ ID NO: 10783 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 58 to correspond to the nucleotides in an oligonucleotide probe downstream of the discriminating single nucleotide polymorphism.
gcyytwtkyccacaratttctatrrbtayytshtcatayt

SEQ ID NO: 10784 - DNA, 40 bp, Artificial Sequence; identical to SEQ ID NO: 10783
  Pan degenerate oligonucleotide primer
  primer_bind (1)..(40)
  modified_base (4)..(4): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10785 - DNA, 40 bp, Artificial Sequence; identical to SEQ ID NO: 10783
  Pan degenerate oligonucleotide primer
  primer_bind (1)..(40)
  modified_base (3)..(3): base is a locked nucleic acid
  modified_base (4)..(4): base is a locked nucleic acid
  modified_base (10)..(10): base is a locked nucleic acid
  misc_feature (34)..(40): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10786 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 58 to correspond to the nucleotides in an oligonucleotide probe downstream of the discriminating single nucleotide polymorphism.
yytwtkyccacaratttctatrrbtayytshtcatayt

SEQ ID NO: 10787 - DNA, 38 bp, Artificial Sequence; identical to SEQ ID NO: 10786
  Pan degenerate oligonucleotide primer
  primer_bind (1)..(38)
  modified_base (1)..(1): base is a locked nucleic acid
  modified_base (5)..(5): base is a locked nucleic acid
  modified_base (8)..(8): base is a locked nucleic acid
  misc_feature (32)..(38): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10788 - DNA, 38 bp, Artificial Sequence; identical to SEQ ID NO: 10786
  Pan degenerate oligonucleotide primer
  primer_bind (1)..(38)
  modified_base (1)..(1): base is a locked nucleic acid
  modified_base (2)..(2): base is a locked nucleic acid
  modified_base (8)..(8): base is a locked nucleic acid
  misc_feature (32)..(38): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10789 - DNA, 37 bp, Artificial Sequence
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 58 to correspond to the nucleotides in an oligonucleotide probe downstream of the discriminating single nucleotide polymorphism.
ytwtkyccacaratttctatrrbtayytshtcatayt

SEQ ID NO: 10790 - DNA, 37 bp, Artificial Sequence; identical to SEQ ID NO: 10789
  Pan degenerate oligonucleotide primer
  primer_bind (1)..(37)
  modified_base (1)..(1): base is a locked nucleic acid
  modified_base (7)..(7): base is a locked nucleic acid
  modified_base (10)..(10): base is a locked nucleic acid
  misc_feature (31)..(37): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10791 - DNA, 37 bp, Artificial Sequence; identical to SEQ ID NO: 10789
  Pan degenerate oligonucleotide primer
  primer_bind (1)..(37)
  modified_base (1)..(1): base is a locked nucleic acid
  modified_base (4)..(4): base is a locked nucleic acid
  modified_base (10)..(10): base is a locked nucleic acid
  misc_feature (31)..(37): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10792 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 58 to correspond to the nucleotides in an oligonucleotide probe downstream of the discriminating single nucleotide polymorphism.
tkyccacaratttctatrrbtayytshtcatayt

SEQ ID NO: 10793 - DNA, 34 bp, Artificial Sequence; identical to SEQ ID NO: 10792
  Pan degenerate oligonucleotide primer
  primer_bind (1)..(34)
  modified_base (1)..(1): base is a locked nucleic acid
  modified_base (7)..(7): base is a locked nucleic acid
  modified_base (13)..(13): base is a locked nucleic acid
  misc_feature (28)..(34): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10794 - DNA, 34 bp, Artificial Sequence; identical to SEQ ID NO: 10792
  Pan degenerate oligonucleotide primer
  primer_bind (1)..(34)
  modified_base (1)..(1): base is a locked nucleic acid
  modified_base (4)..(4): base is a locked nucleic acid
  modified_base (13)..(13): base is a locked nucleic acid
  misc_feature (28)..(34): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10795 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (10)..(10): base is a locked nucleic acid
  misc_feature (25)..(31): Adaptor region of the pan degenerate antisense primer that adapts the probe-binding site downstream of codon 58 to correspond to the nucleotides in an oligonucleotide probe downstream of the discriminating single nucleotide polymorphism.
ccacaratttctatrrbtayytshtcatayt

SEQ ID NO: 10796 - DNA, 31 bp, Artificial Sequence; identical to SEQ ID NO: 10795
  Pan degenerate oligonucleotide primer
  primer_bind (1)..(31)
  modified_base (1)..(1): base is a locked nucleic acid
  modified_base (10)..(10): base is a locked nucleic acid
  modified_base (12)..(12): base is a locked nucleic acid
  misc_feature (25)..(31): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10797 - DNA, 31 bp, Artificial Sequence; identical to SEQ ID NO: 10795
  Pan degenerate oligonucleotide primer
  primer_bind (1)..(31)
  modified_base (1)..(1): base is a locked nucleic acid
  modified_base (4)..(4): base is a locked nucleic acid
  modified_base (12)..(12): base is a locked nucleic acid
  misc_feature (25)..(31): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10798 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (9)..(9): base is a locked nucleic acid
  misc_feature (22)..(28): Adaptor region of the pan degenerate antisense primer that adapts the probe-binding site downstream of codon 58 to correspond to the nucleotides in an oligonucleotide probe downstream of the discriminating single nucleotide polymorphism.
caratttctatrrbtayytshtcatayt

SEQ ID NO: 10799 - DNA, 28 bp, Artificial Sequence
  Pan degenerate oligonucleotide primer
  primer_bind (1)..(28)
  modified_base (1)..(1): base is a locked nucleic acid
  modified_base (9)..(9): base is a locked nucleic acid
  modified_base (10)..(10): base is a locked nucleic acid
  misc_feature (22)..(28): Adaptor region of the pan degenerate antisense primer that adapts the probe-binding site downstream of codon 58 to correspond to the nucleotides in an oligonucleotide probe downstream of the discriminating single nucleotide polymorphism.
caratttctatrrbtayytshtcatayt

SEQ ID NO: 10800 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (10)..(10): base is a locked nucleic acid
  misc_feature (22)..(28): Adaptor region of the pan degenerate antisense primer that adapts the probe-binding site downstream of codon 58 to correspond to the nucleotides in an oligonucleotide probe downstream of the discriminating single nucleotide polymorphism.
caratttctatrrbtayytshtcatayt

SEQ ID NO: 10801 - DNA, 40 bp, Artificial Sequence; identical to SEQ ID NO: 10783
  Pan degenerate oligonucleotide primer
  primer_bind (1)..(40)
  misc_feature (34)..(40): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10802 - DNA, 38 bp, Artificial Sequence; identical to SEQ ID NO: 10786
  Pan degenerate oligonucleotide primer
  primer_bind (1)..(38)
  misc_feature (32)..(38): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10803 - DNA, 37 bp, Artificial Sequence; identical to SEQ ID NO: 10789
  Pan degenerate oligonucleotide primer
  primer_bind (1)..(37)
  misc_feature (31)..(37): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10804 - DNA, 34 bp, Artificial Sequence; identical to SEQ ID NO: 10792
  Pan degenerate oligonucleotide primer
  primer_bind (1)..(34)
  misc_feature (28)..(34): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10805 - DNA, 31 bp, Artificial Sequence; identical to SEQ ID NO: 10795
  Pan degenerate oligonucleotide primer
  primer_bind (1)..(31)
  misc_feature (25)..(31): Adaptor region of the pan degenerate antisense primer that adapts the probe-binding site downstream of codon 58 to correspond to the nucleotides in an oligonucleotide probe downstream of the discriminating single nucleotide polymorphism.

SEQ ID NO: 10806 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 58 to correspond to the nucleotides in an oligonucleotide probe downstream of the discriminating single nucleotide polymorphism.
caratttctatrrbtayytshtcatayt

SEQ ID NO: 10807 - DNA, 50 bp, Artificial Sequence
  Pan degenerate oligonucleotide primer
  primer_bind (1)..(50)
  misc_feature (38)..(38): n is a, c, g, or t
  misc_feature (44)..(50): Adaptor region of the pan degenerate antisense primer that adapts the probe-binding site downstream of codon 58 to correspond to the nucleotides in an oligonucleotide probe downstream of the discriminating single nucleotide polymorphism.
actgtacctryrryyytdtkyccrcaratytctayddntaybtsmtcata

SEQ ID NO: 10808 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 58 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gcyytwtkyccacaratttctatrrbtayytshtcataytn

SEQ ID NO: 10809 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 58 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
yytwtkyccacaratttctatrrbtayytshtcataytn

SEQ ID NO: 10810 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 58 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ytwtkyccacaratttctatrrbtayytshtcataytn

SEQ ID NO: 10811 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 58 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tkyccacaratttctatrrbtayytshtcataytn

SEQ ID NO: 10812 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 58 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ccacaratttctatrrbtayytshtcataytn

SEQ ID NO: 10813 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 58 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
caratttctatrrbtayytshtcataytn

SEQ ID NO: 10814 - DNA, 51 bp, Artificial Sequence
  Pan degenerate oligonucleotide primer
  primer_bind (1)..(51)
  misc_feature (38)..(38): n is a, c, g, or t
  misc_feature (44)..(50): Adaptor region of the pan degenerate antisense primer that adapts the probe-binding site downstream of codon 58 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
actgtacctryrryyytdtkyccrcaratytctayddntaybtsmtcatan

SEQ ID NO: 10815 - DNA, 40 bp, Artificial Sequence
  Pan degenerate oligonucleotide primer
  primer_bind (1)..(40)
  modified_base (7)..(7): base is a locked nucleic acid
  modified_base (10)..(10): base is a locked nucleic acid
  modified_base (13)..(13): base is a locked nucleic acid
  misc_feature (34)..(40): Adaptor region of the pan degenerate antisense primer that adapts the probe-binding site downstream of codon 71 to correspond to the nucleotides in an oligonucleotide probe downstream of the discriminating single nucleotide polymorphism.
atgttgayaggtgtrggyccyayyaryactgwacctatrg

SEQ ID NO: 10816 - DNA, 40 bp, Artificial Sequence; identical to SEQ ID NO: 10815
  Pan degenerate oligonucleotide primer
  primer_bind (1)..(40)
  modified_base (1)..(1): base is a locked nucleic acid
  modified_base (7)..(7): base is a locked nucleic acid
  modified_base (13)..(13): base is a locked nucleic acid
  misc_feature (34)..(40): Adaptor region of the pan degenerate antisense primer that adapts the probe-binding site downstream of codon 71 to correspond to the nucleotides in an oligonucleotide probe downstream of the discriminating single nucleotide polymorphism.

SEQ ID NO: 10817 - DNA, 40 bp, Artificial Sequence; identical to SEQ ID NO: 10815
  Pan degenerate oligonucleotide primer
  primer_bind (1)..(40)
  modified_base (1)..(1): base is a locked nucleic acid
  modified_base (7)..(7): base is a locked nucleic acid
  modified_base (13)..(13): base is a locked nucleic acid
  misc_feature (34)..(40): Adaptor region of the pan degenerate antisense primer that adapts the probe-binding site downstream of codon 71 to correspond to the nucleotides in an oligonucleotide probe downstream of the discriminating single nucleotide polymorphism.

SEQ ID NO: 10818 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 71 to correspond to the nucleotides in an oligonucleotide probe downstream of the discriminating single nucleotide polymorphism.
ggtgtrggyccyayyaryactgwacctatrg

SEQ ID NO: 10819 - DNA, 31 bp, Artificial Sequence; identical to SEQ ID NO: 10818
  Pan degenerate oligonucleotide primer
  primer_bind (1)..(31)
  modified_base (1)..(1): base is a locked nucleic acid
  modified_base (7)..(7): base is a locked nucleic acid
  modified_base (10)..(10): base is a locked nucleic acid
  misc_feature (25)..(31): Adaptor region of the pan degenerate antisense primer that adapts the probe-binding site downstream of codon 71 to correspond to the nucleotides in an oligonucleotide probe downstream of the discriminating single nucleotide polymorphism.

SEQ ID NO: 10820 - DNA, 31 bp, Artificial Sequence; identical to SEQ ID NO: 10818
  Pan degenerate oligonucleotide primer
  primer_bind (1)..(31)
  modified_base (1)..(1): base is a locked nucleic acid
  modified_base (4)..(4): base is a locked nucleic acid
  modified_base (10)..(10): base is a locked nucleic acid
  misc_feature (25)..(31): Adaptor region of the pan degenerate antisense primer that adapts the probe-binding site downstream of codon 71 to correspond to the nucleotides in an oligonucleotide probe downstream of the discriminating single nucleotide polymorphism.

SEQ ID NO: 10821 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 71 to correspond to the nucleotides in an oligonucleotide probe downstream of the discriminating single nucleotide polymorphism.
gtrggyccyayyaryactgwacctatrg

SEQ ID NO: 10822 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (9)..(9): base is a locked nucleic acid
  misc_feature (22)..(28): Adaptor region of the pan degenerate antisense primer that adapts the probe-binding site downstream of codon 71 to correspond to the nucleotides in an oligonucleotide probe downstream of the discriminating single nucleotide polymorphism.
gtrggyccyayyaryactgwacctatrg

SEQ ID NO: 10823 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (9)..(9): base is a locked nucleic acid
  misc_feature (22)..(28): Adaptor region of the pan degenerate antisense primer that adapts the probe-binding site downstream of codon 71 to correspond to the nucleotides in an oligonucleotide probe downstream of the discriminating single nucleotide polymorphism.
gtrggyccyayyaryactgwacctatrg

SEQ ID NO: 10824 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (6)..(6): base is a locked nucleic acid
  misc_feature (19)..(25): Adaptor region of the pan degenerate antisense primer that adapts the probe-binding site downstream of codon 71 to correspond to the nucleotides in an oligonucleotide probe downstream of the discriminating single nucleotide polymorphism.
ggyccyayyaryactgwacctatrg

SEQ ID NO: 10825 - DNA, 25 bp, Artificial Sequence
  Pan degenerate oligonucleotide primer
  primer_bind (1)..(25)
  modified_base (1)..(1): base is a locked nucleic acid
  modified_base (6)..(6): base is a locked nucleic acid
  modified_base (7)..(7): base is a locked nucleic acid
  misc_feature (19)..(25): Adaptor region of the pan degenerate antisense primer that adapts the probe-binding site downstream of codon 71 to correspond to the nucleotides in an oligonucleotide probe downstream of the discriminating single nucleotide polymorphism.
ggyccyayyaryactgwacctatrg

SEQ ID NO: 10826 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (7)..(7): base is a locked nucleic acid
  misc_feature (19)..(25): Adaptor region of the pan degenerate antisense primer that adapts the probe-binding site downstream of codon 71 to correspond to the nucleotides in an oligonucleotide probe downstream of the discriminating single nucleotide polymorphism.
ggyccyayyaryactgwacctatrg

SEQ ID NO: 10827 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (4)..(4): base is a locked nucleic acid
  misc_feature (16)..(22): Adaptor region of the pan degenerate antisense primer that adapts the probe-binding site downstream of codon 71 to correspond to the nucleotides in an oligonucleotide probe downstream of the discriminating single nucleotide polymorphism.
ccyayyaryactgwacctatrg

SEQ ID NO: 10828 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (7)..(7): base is a locked nucleic acid
  misc_feature (16)..(22): Adaptor region of the pan degenerate antisense primer that adapts the probe-binding site downstream of codon 71 to correspond to the nucleotides in an oligonucleotide probe downstream of the discriminating single nucleotide polymorphism.
ccyayyaryactgwacctatrg

SEQ ID NO: 10829 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (7)..(7): base is a locked nucleic acid
  misc_feature (16)..(22): Adaptor region of the pan degenerate antisense primer that adapts the probe-binding site downstream of codon 71 to correspond to the nucleotides in an oligonucleotide probe downstream of the discriminating single nucleotide polymorphism.
ccyayyaryactgwacctatrg

SEQ ID NO: 10830 - DNA, 20 bp, Artificial Sequence
  Pan degenerate oligonucleotide primer
  primer_bind (1)..(20)
  modified_base (1)..(1): base is a locked nucleic acid
  modified_base (2)..(2): base is a locked nucleic acid
  modified_base (5)..(5): base is a locked nucleic acid
  misc_feature (14)..(20): Adaptor region of the pan degenerate antisense primer that adapts the probe-binding site downstream of codon 71 to correspond to the nucleotides in an oligonucleotide probe downstream of the discriminating single nucleotide polymorphism.
yayyaryactgwacctatrg

SEQ ID NO: 10831 - DNA, 20 bp, Artificial Sequence
  Pan degenerate oligonucleotide primer
  primer_bind (1)..(20)
  modified_base (1)..(1): base is a locked nucleic acid
  modified_base (5)..(5): base is a locked nucleic acid
  modified_base (7)..(7): base is a locked nucleic acid
  misc_feature (14)..(20): Adaptor region of the pan degenerate antisense primer that adapts the probe-binding site downstream of codon 71 to correspond to the nucleotides in an oligonucleotide probe downstream of the discriminating single nucleotide polymorphism.
yayyaryactgwacctatrg

SEQ ID NO: 10832 - DNA, 20 bp, Artificial Sequence
  Pan degenerate oligonucleotide primer
  primer_bind (1)..(20)
  modified_base (1)..(1): base is a locked nucleic acid
  modified_base (2)..(2): base is a locked nucleic acid
  modified_base (7)..(7): base is a locked nucleic acid
  misc_feature (14)..(20): Adaptor region of the pan degenerate antisense primer that adapts the probe-binding site downstream of codon 71 to correspond to the nucleotides in an oligonucleotide probe downstream of the discriminating single nucleotide polymorphism.
yayyaryactgwacctatrg

SEQ ID NO: 10833 - DNA, 40 bp, Artificial Sequence; identical to SEQ ID NO: 10815
  Pan degenerate oligonucleotide primer
  primer_bind (1)..(40)
  misc_feature (34)..(40): Adaptor region of the pan degenerate antisense primer that adapts the probe-binding site downstream of codon 71 to correspond to the nucleotides in an oligonucleotide probe downstream of the discriminating single nucleotide polymorphism.

SEQ ID NO: 10834 - DNA, 31 bp, Artificial Sequence; identical to SEQ ID NO: 10818
  Pan degenerate oligonucleotide primer
  primer_bind (1)..(31)
  misc_feature (25)..(31): Adaptor region of the pan degenerate antisense primer that adapts the probe-binding site downstream of codon 71 to correspond to the nucleotides in an oligonucleotide probe downstream of the discriminating single nucleotide polymorphism.

SEQ ID NO: 10835 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 71 to correspond to the nucleotides in an oligonucleotide probe downstream of the discriminating single nucleotide polymorphism.
gtrggyccyayyaryactgwacctatrg

SEQ ID NO: 10836 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 71 to correspond to the nucleotides in an oligonucleotide probe downstream of the discriminating single nucleotide polymorphism.
ggyccyayyaryactgwacctatrg

SEQ ID NO: 10837 - DNA, 22 bp, Artificial Sequence
  Pan degenerate oligonucleotide primer
  primer_bind (1)..(22)
  misc_feature (16)..(22): Adaptor region of the pan degenerate antisense primer that adapts the probe-binding site downstream of codon 71 to correspond to the nucleotides in an oligonucleotide probe downstream of the discriminating single nucleotide polymorphism.
ccyayyaryactgwacctatrg

SEQ ID NO: 10838 - DNA, 20 bp, Artificial Sequence
  Pan degenerate oligonucleotide primer
  primer_bind (1)..(20)
  misc_feature (14)..(20): Adaptor region of the pan degenerate antisense primer that adapts the probe-binding site downstream of codon 71 to correspond to the nucleotides in an oligonucleotide probe downstream of the discriminating single nucleotide polymorphism.
yayyaryactgwacctatrg

SEQ ID NO: 10839 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 71 to correspond to the nucleotides in an oligonucleotide probe downstream of the discriminating single nucleotide polymorphism.
rttyckyccaattatgttgryaggkgtrggycctayyaayactgtacctat

SEQ ID NO: 10840 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 71 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
atgttgayaggtgtrggyccyayyaryactgwacctatrgn

SEQ ID NO: 10841 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 71 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ggtgtrggyccyayyaryactgwacctatrgn

SEQ ID NO: 10842 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 71 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
gtrggyccyayyaryactgwacctatrgn

SEQ ID NO: 10843 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 71 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
ggyccyayyaryactgwacctatrgn

SEQ ID NO: 10844 - DNA, 23 bp, Artificial Sequence
  Pan degenerate oligonucleotide primer
  primer_bind (1)..(23)
  misc_feature (16)..(22): Adaptor region of the pan degenerate antisense primer that adapts the probe-binding site downstream of codon 71 to correspond to the nucleotides in an oligonucleotide probe downstream of the discriminating single nucleotide polymorphism.
  modified_base (23)..(23): base is a locked nucleic acid
  misc_feature (23)..(23): n is a, c, g, or t
ccyayyaryactgwacctatrgn

SEQ ID NO: 10845 - DNA, 21 bp, Artificial Sequence
  Pan degenerate oligonucleotide primer
  primer_bind (1)..(21)
  misc_feature (14)..(20): Adaptor region of the pan degenerate antisense primer that adapts the probe-binding site downstream of codon 71 to correspond to the nucleotides in an oligonucleotide probe downstream of the discriminating single nucleotide polymorphism.
  modified_base (21)..(21): base is a locked nucleic acid
  misc_feature (21)..(21): n is a, c, g, or t
yayyaryactgwacctatrgn

SEQ ID NO: 10846 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 71 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rttyckyccaattatgttgryaggkgtrggycctayyaayactgtacctatn

SEQ ID NO: 10847 - DNA, 40 bp, Artificial Sequence
  Pan degenerate oligonucleotide primer
  primer_bind (1)..(40)
  modified_base (3)..(3): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.
yccaattatgttgayaggtgtrggyccyayyaryactgwa

SEQ ID NO: 10848 - DNA, 40 bp, Artificial Sequence; identical to SEQ ID NO: 10847
  Pan degenerate oligonucleotide primer
  primer_bind (1)..(40)
  modified_base (3)..(3): base is a locked nucleic acid
  modified_base (9)..(9): base is a locked nucleic acid
  modified_base (12)..(12): base is a locked nucleic acid
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10849 - DNA, 40 bp, Artificial Sequence; identical to SEQ ID NO: 10847
  Pan degenerate oligonucleotide primer
  primer_bind (1)..(40)
  modified_base (3)..(3): base is a locked nucleic acid
  modified_base (6)..(6): base is a locked nucleic acid
  modified_base (12)..(12): base is a locked nucleic acid
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10850 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 73 to correspond to the nucleotides in an oligonucleotide probe downstream of the discriminating single nucleotide polymorphism.
ttatgttgayaggtgtrggyccyayyaryactgwa

SEQ ID NO: 10851 - DNA, 35 bp, Artificial Sequence; identical to SEQ ID NO: 10850
  Pan degenerate oligonucleotide primer
  primer_bind (1)..(35)
  modified_base (1)..(1): base is a locked nucleic acid
  modified_base (7)..(7): base is a locked nucleic acid
  modified_base (9)..(9): base is a locked nucleic acid
  misc_feature (29)..(35): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10852 - DNA, 35 bp, Artificial Sequence; identical to SEQ ID NO: 10850
  Pan degenerate oligonucleotide primer
  primer_bind (1)..(35)
  modified_base (1)..(1): base is a locked nucleic acid
  modified_base (4)..(4): base is a locked nucleic acid
  modified_base (9)..(9): base is a locked nucleic acid
  misc_feature (29)..(35): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10853 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate antisense primer that adapts the probe-binding site downstream of codon 73 to correspond to the nucleotides in an oligonucleotide probe downstream of the discriminating single nucleotide polymorphism.
tgttgayaggtgtrggyccyayyaryactgwa

SEQ ID NO: 10854 - DNA, 32 bp, Artificial Sequence; identical to SEQ ID NO: 10853
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10855 - DNA, 32 bp, Artificial Sequence; identical to SEQ ID NO: 10853
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10856 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate antisense primer that adapts the probe-binding site downstream of codon 73 to correspond to the nucleotides in an oligonucleotide probe downstream of the discriminating single nucleotide polymorphism.
tgayaggtgtrggyccyayyaryactgwa

SEQ ID NO: 10857 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate antisense primer that adapts the probe-binding site downstream of codon 73 to correspond to the nucleotides in an oligonucleotide probe downstream of the discriminating single nucleotide polymorphism.
tgayaggtgtrggyccyayyaryactgwa

SEQ ID NO: 10858 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (7)..(7): base is a locked nucleic acid
  misc_feature (23)..(29): Adaptor region of the pan degenerate antisense primer that adapts the probe-binding site downstream of codon 73 to correspond to the nucleotides in an oligonucleotide probe downstream of the discriminating single nucleotide polymorphism.
tgayaggtgtrggyccyayyaryactgwa

SEQ ID NO: 10859 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwa

SEQ ID NO: 10860 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (7)..(7): base is a locked nucleic acid
  misc_feature (21)..(27): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwa

SEQ ID NO: 10861 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (7)..(7): base is a locked nucleic acid
  misc_feature (21)..(27): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwa

SEQ ID NO: 10862 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (6)..(6): base is a locked nucleic acid
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
yaggtgtrggyccyayyaryactgwa

SEQ ID NO: 10863 - DNA, 26 bp, Artificial Sequence
  Pan degenerate oligonucleotide primer
  primer_bind (1)..(26)
  modified_base (1)..(1): base is a locked nucleic acid
  modified_base (6)..(6): base is a locked nucleic acid
  modified_base (7)..(7): base is a locked nucleic acid
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
yaggtgtrggyccyayyaryactgwa

SEQ ID NO: 10864 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (7)..(7): base is a locked nucleic acid
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
yaggtgtrggyccyayyaryactgwa

SEQ ID NO: 10865 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.
ccaattatgttgayaggtgtrggyccyayyaryactgwac

SEQ ID NO: 10866 - DNA, 40 bp, Artificial Sequence; identical to SEQ ID NO: 10865
  Pan degenerate oligonucleotide primer
  primer_bind (1)..(40)
  modified_base (1)..(1): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10867 - DNA, 40 bp, Artificial Sequence; identical to SEQ ID NO: 10865
  Pan degenerate oligonucleotide primer
  primer_bind (1)..(40)
  modified_base (1)..(1): base is a locked nucleic acid
  modified_base (4)..(4): base is a locked nucleic acid
  modified_base (10)..(10): base is a locked nucleic acid
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10868 - DNA, 37 bp, Artificial Sequence
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 73 to correspond to the nucleotides in an oligonucleotide probe downstream of the discriminating single nucleotide polymorphism.
attatgttgayaggtgtrggyccyayyaryactgwac

SEQ ID NO: 10869 - DNA, 37 bp, Artificial Sequence; identical to SEQ ID NO: 10868
  Pan degenerate oligonucleotide primer
  primer_bind (1)..(37)
  modified_base (1)..(1): base is a locked nucleic acid
  modified_base (7)..(7): base is a locked nucleic acid
  modified_base (10)..(10): base is a locked nucleic acid
  misc_feature (31)..(37): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10870 - DNA, 37 bp, Artificial Sequence; identical to SEQ ID NO: 10868
  Pan degenerate oligonucleotide primer
  primer_bind (1)..(37)
  modified_base (1)..(1): base is a locked nucleic acid
  modified_base (4)..(4): base is a locked nucleic acid
  modified_base (10)..(10): base is a locked nucleic acid
  misc_feature (31)..(37): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10871 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 73 to correspond to the nucleotides in an oligonucleotide probe downstream of the discriminating single nucleotide polymorphism.
atgttgayaggtgtrggyccyayyaryactgwac

SEQ ID NO: 10872 - DNA, 34 bp, Artificial Sequence; identical to SEQ ID NO: 10871
  Pan degenerate oligonucleotide primer
  primer_bind (1)..(34)
  modified_base (1)..(1): base is a locked nucleic acid
  modified_base (7)..(7): base is a locked nucleic acid
  modified_base (9)..(9): base is a locked nucleic acid
  misc_feature (28)..(34): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10873 - DNA, 34 bp, Artificial Sequence; identical to SEQ ID NO: 10871
  Pan degenerate oligonucleotide primer
  primer_bind (1)..(34)
  modified_base (1)..(1): base is a locked nucleic acid
  modified_base (4)..(4): base is a locked nucleic acid
  modified_base (9)..(9): base is a locked nucleic acid
  misc_feature (28)..(34): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10874 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 73 to correspond to the nucleotides in an oligonucleotide probe downstream of the discriminating single nucleotide polymorphism.
ttgayaggtgtrggyccyayyaryactgwac

SEQ ID NO: 10875 - DNA, 31 bp, Artificial Sequence; identical to SEQ ID NO: 10874
  Pan degenerate oligonucleotide primer
  primer_bind (1)..(31)
  modified_base (1)..(1): base is a locked nucleic acid
  modified_base (6)..(6): base is a locked nucleic acid
  modified_base (7)..(7): base is a locked nucleic acid
  misc_feature (25)..(31): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10876 - DNA, 31 bp, Artificial Sequence; identical to SEQ ID NO: 10874
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10877 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwac

SEQ ID NO: 10878 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwac

SEQ ID NO: 10879 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (7)..(7): base is a locked nucleic acid
  misc_feature (22)..(28): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwac

SEQ ID NO: 10880 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (5)..(5): base is a locked nucleic acid
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
aggtgtrggyccyayyaryactgwac

SEQ ID NO: 10881 - DNA, 26 bp, Artificial Sequence
  Pan degenerate oligonucleotide primer
  primer_bind (1)..(26)
  modified_base (1)..(1): base is a locked nucleic acid
  modified_base (5)..(5): base is a locked nucleic acid
  modified_base (7)..(7): base is a locked nucleic acid
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
aggtgtrggyccyayyaryactgwac

SEQ ID NO: 10882 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (7)..(7): base is a locked nucleic acid
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
aggtgtrggyccyayyaryactgwac

SEQ ID NO: 10883 - DNA, 40 bp, Artificial Sequence; identical to SEQ ID NO: 10847
  Pan degenerate oligonucleotide primer
  primer_bind (1)..(40)
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10884 - DNA, 35 bp, Artificial Sequence; identical to SEQ ID NO: 10850
  Pan degenerate oligonucleotide primer
  primer_bind (1)..(35)
  misc_feature (29)..(35): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10885 - DNA, 32 bp, Artificial Sequence; identical to SEQ ID NO: 10853
  Pan degenerate oligonucleotide primer
  primer_bind (1)..(32)
  misc_feature (26)..(32): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10886 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 73 to correspond to the nucleotides in an oligonucleotide probe downstream of the discriminating single nucleotide polymorphism.
tgayaggtgtrggyccyayyaryactgwa

SEQ ID NO: 10887 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwa

SEQ ID NO: 10888 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
yaggtgtrggyccyayyaryactgwa

SEQ ID NO: 10889 - DNA, 40 bp, Artificial Sequence; identical to SEQ ID NO: 10865
  Pan degenerate oligonucleotide primer
  primer_bind (1)..(40)
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10890 - DNA, 37 bp, Artificial Sequence; identical to SEQ ID NO: 10868
  Pan degenerate oligonucleotide primer
  primer_bind (1)..(37)
  misc_feature (31)..(37): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10891 - DNA, 34 bp, Artificial Sequence; identical to SEQ ID NO: 10871
  Pan degenerate oligonucleotide primer
  primer_bind (1)..(34)
  misc_feature (28)..(34): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10892 - DNA, 31 bp, Artificial Sequence; identical to SEQ ID NO: 10874
  Pan degenerate oligonucleotide primer
  primer_bind (1)..(31)
  misc_feature (25)..(31): Adaptor region of the pan degenerate antisense primer that adapts the probe-binding site downstream of codon 73 to correspond to the nucleotides in an oligonucleotide probe downstream of the discriminating single nucleotide polymorphism.

SEQ ID NO: 10893 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 73 to correspond to the nucleotides in an oligonucleotide probe downstream of the discriminating single nucleotide polymorphism.
ayaggtgtrggyccyayyaryactgwac

SEQ ID NO: 10894 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
aggtgtrggyccyayyaryactgwac

SEQ ID NO: 10895 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 73 to correspond to the nucleotides in an oligonucleotide probe downstream of the discriminating single nucleotide polymorphism.
cawcadrttyckyccaattatgttgryaggkgtrggycctayyaatactgt

SEQ ID NO: 10896 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yccaattatgttgayaggtgtrggyccyayyaryactgwan

SEQ ID NO: 10897 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ttatgttgayaggtgtrggyccyayyaryactgwan

SEQ ID NO: 10898 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tgttgayaggtgtrggyccyayyaryactgwan

SEQ ID NO: 10899 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
tgayaggtgtrggyccyayyaryactgwan

SEQ ID NO: 10900 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
ayaggtgtrggyccyayyaryactgwan

SEQ ID NO: 10901 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
yaggtgtrggyccyayyaryactgwan

SEQ ID NO: 10902 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ccaattatgttgayaggtgtrggyccyayyaryactgwacn

SEQ ID NO: 10903 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
attatgttgayaggtgtrggyccyayyaryactgwacn

SEQ ID NO: 10904 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
atgttgayaggtgtrggyccyayyaryactgwacn

SEQ ID NO: 10905 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ttgayaggtgtrggyccyayyaryactgwacn

SEQ ID NO: 10906 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
ayaggtgtrggyccyayyaryactgwacn

SEQ ID NO: 10907 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
aggtgtrggyccyayyaryactgwacn

SEQ ID NO: 10908 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 73 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
cawcadrttyckyccaattatgttgryaggkgtrggycctayyaatactgtn

SEQ ID NO: 10909 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.
ckyccaattatgttgayaggtgtrggyccyayyaryactg

SEQ ID NO: 10910 - DNA, 40 bp, Artificial Sequence; identical to SEQ ID NO: 10909
  Pan degenerate oligonucleotide primer
  primer_bind (1)..(40)
  modified_base (1)..(1): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10911 - DNA, 40 bp, Artificial Sequence; identical to SEQ ID NO: 10909
  Pan degenerate oligonucleotide primer
  primer_bind (1)..(40)
  modified_base (1)..(1): base is a locked nucleic acid
  modified_base (4)..(4): base is a locked nucleic acid
  modified_base (10)..(10): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10912 - DNA, 37 bp, Artificial Sequence
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.
ccaattatgttgayaggtgtrggyccyayyaryactg

SEQ ID NO: 10913 - DNA, 37 bp, Artificial Sequence; identical to SEQ ID NO: 10912
  Pan degenerate oligonucleotide primer
  primer_bind (1)..(37)
  modified_base (1)..(1): base is a locked nucleic acid
  modified_base (7)..(7): base is a locked nucleic acid
  modified_base (9)..(9): base is a locked nucleic acid
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10914 - DNA, 37 bp, Artificial Sequence; identical to SEQ ID NO: 10912
  Pan degenerate oligonucleotide primer
  primer_bind (1)..(37)
  modified_base (1)..(1): base is a locked nucleic acid
  modified_base (4)..(4): base is a locked nucleic acid
  modified_base (9)..(9): base is a locked nucleic acid
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10915 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.
attatgttgayaggtgtrggyccyayyaryactg

SEQ ID NO: 10916 - DNA, 34 bp, Artificial Sequence; identical to SEQ ID NO: 10915
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10917 - DNA, 34 bp, Artificial Sequence; identical to SEQ ID NO: 10915
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10918 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.
atgttgayaggtgtrggyccyayyaryactg

SEQ ID NO: 10919 - DNA, 31 bp, Artificial Sequence; identical to SEQ ID NO: 10918
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10920 - DNA, 31 bp, Artificial Sequence; identical to SEQ ID NO: 10918
  Pan degenerate oligonucleotide primer
  primer_bind (1)..(31)
  modified_base (1)..(1): base is a locked nucleic acid
  modified_base (3)..(3): base is a locked nucleic acid
  modified_base (7)..(7): base is a locked nucleic acid
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10921 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
gttgayaggtgtrggyccyayyaryactg

SEQ ID NO: 10922 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (7)..(7): base is a locked nucleic acid
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
gttgayaggtgtrggyccyayyaryactg

SEQ ID NO: 10923 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (7)..(7): base is a locked nucleic acid
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
gttgayaggtgtrggyccyayyaryactg

SEQ ID NO: 10924 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ttgayaggtgtrggyccyayyaryactg

SEQ ID NO: 10925 - DNA, 28 bp, Artificial Sequence
  Pan degenerate oligonucleotide primer
  primer_bind (1)..(28)
  modified_base (1)..(1): base is a locked nucleic acid
  modified_base (6)..(6): base is a locked nucleic acid
  modified_base (7)..(7): base is a locked nucleic acid
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ttgayaggtgtrggyccyayyaryactg

SEQ ID NO: 10926 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ttgayaggtgtrggyccyayyaryactg

SEQ ID NO: 10927 - DNA, 40 bp, Artificial Sequence; identical to SEQ ID NO: 10909
  Pan degenerate oligonucleotide primer
  primer_bind (1)..(40)
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10928 - DNA, 37 bp, Artificial Sequence; identical to SEQ ID NO: 10912
  Pan degenerate oligonucleotide primer
  primer_bind (1)..(37)
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10929 - DNA, 34 bp, Artificial Sequence; identical to SEQ ID NO: 10915
  Pan degenerate oligonucleotide primer
  primer_bind (1)..(34)
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10930 - DNA, 31 bp, Artificial Sequence; identical to SEQ ID NO: 10918
  Pan degenerate oligonucleotide primer
  primer_bind (1)..(31)
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 10931 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
gttgayaggtgtrggyccyayyaryactg

SEQ ID NO: 10932 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ttgayaggtgtrggyccyayyaryactg

SEQ ID NO: 10933 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 74 to correspond to the nucleotides in an oligonucleotide probe downstream of the discriminating single nucleotide polymorphism.
rgtcawcadrttyckyccaattatgttgryaggkgtrggycctaytaatac

SEQ ID NO: 10934 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ckyccaattatgttgayaggtgtrggyccyayyaryactgn

SEQ ID NO: 10935 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ccaattatgttgayaggtgtrggyccyayyaryactgn

SEQ ID NO: 10936 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
attatgttgayaggtgtrggyccyayyaryactgn

SEQ ID NO: 10937 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
atgttgayaggtgtrggyccyayyaryactgn

SEQ ID NO: 10938 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
gttgayaggtgtrggyccyayyaryactgn

SEQ ID NO: 10939 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
ttgayaggtgtrggyccyayyaryactgn

SEQ ID NO: 10940 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rgtcawcadrttyckyccaattatgttgryaggkgtrggycctaytaatacn

SEQ ID NO: 10941 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 76 to correspond to the nucleotides in an oligonucleotide probe downstream of the discriminating single nucleotide polymorphism.
adrttyckyccaattatgttgayaggtgtrggyccyayya

SEQ ID NO: 10942 - DNA, 40 bp, Artificial Sequence; identical to SEQ ID NO: 10941
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10943 - DNA, 40 bp, Artificial Sequence; identical to SEQ ID NO: 10941
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10944 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 76 to correspond to the nucleotides in an oligonucleotide probe downstream of the discriminating single nucleotide polymorphism.
ttyckyccaattatgttgayaggtgtrggyccyayya

SEQ ID NO: 10945 - DNA, 37 bp, Artificial Sequence; identical to SEQ ID NO: 10944
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10946 - DNA, 37 bp, Artificial Sequence; identical to SEQ ID NO: 10944
  Pan degenerate oligonucleotide primer
  primer_bind (1)..(37)
  modified_base (1)..(1): base is a locked nucleic acid
  modified_base (3)..(3): base is a locked nucleic acid
  modified_base (7)..(7): base is a locked nucleic acid
  misc_feature (31)..(37): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10947 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 76 to correspond to the nucleotides in an oligonucleotide probe downstream of the discriminating single nucleotide polymorphism.
yckyccaattatgttgayaggtgtrggyccyayya

SEQ ID NO: 10948 - DNA, 35 bp, Artificial Sequence; identical to SEQ ID NO: 10947
  Pan degenerate oligonucleotide primer
  primer_bind (1)..(35)
  modified_base (1)..(1): base is a locked nucleic acid
  modified_base (5)..(5): base is a locked nucleic acid
  modified_base (7)..(7): base is a locked nucleic acid
  misc_feature (29)..(35): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10949 - DNA, 35 bp, Artificial Sequence; identical to SEQ ID NO: 10947
  Pan degenerate oligonucleotide primer
  primer_bind (1)..(35)
  modified_base (1)..(1): base is a locked nucleic acid
  modified_base (2)..(2): base is a locked nucleic acid
  modified_base (7)..(7): base is a locked nucleic acid
  misc_feature (29)..(35): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10950 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 76 to correspond to the nucleotides in an oligonucleotide probe downstream of the discriminating single nucleotide polymorphism.
ckyccaattatgttgayaggtgtrggyccyayya

SEQ ID NO: 10951 - DNA, 34 bp, Artificial Sequence; identical to SEQ ID NO: 10950
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10952 - DNA, 34 bp, Artificial Sequence; identical to SEQ ID NO: 10950
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10953 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 76 to correspond to the nucleotides in an oligonucleotide probe downstream of the discriminating single nucleotide polymorphism.
ccaattatgttgayaggtgtrggyccyayya

SEQ ID NO: 10954 - DNA, 31 bp, Artificial Sequence; identical to SEQ ID NO: 10953
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10955 - DNA, 31 bp, Artificial Sequence; identical to SEQ ID NO: 10953
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (25)..(31): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10956 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 76 to correspond to the nucleotides in an oligonucleotide probe downstream of the discriminating single nucleotide polymorphism.
aattatgttgayaggtgtrggyccyayya

SEQ ID NO: 10957 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 76 to correspond to the nucleotides in an oligonucleotide probe downstream of the discriminating single nucleotide polymorphism.
aattatgttgayaggtgtrggyccyayya

SEQ ID NO: 10958 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 76 to correspond to the nucleotides in an oligonucleotide probe downstream of the discriminating single nucleotide polymorphism.
aattatgttgayaggtgtrggyccyayya

SEQ ID NO: 10959 - DNA, 40 bp, Artificial Sequence; identical to SEQ ID NO: 10941
  Pan degenerate oligonucleotide primer
  primer_bind (1)..(40)
  misc_feature (34)..(40): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10960 - DNA, 37 bp, Artificial Sequence; identical to SEQ ID NO: 10944
  Pan degenerate oligonucleotide primer
  primer_bind (1)..(37)
  misc_feature (31)..(37): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10961 - DNA, 35 bp, Artificial Sequence; identical to SEQ ID NO: 10947
  Pan degenerate oligonucleotide primer
  primer_bind (1)..(35)
  misc_feature (29)..(35): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10962 - DNA, 34 bp, Artificial Sequence; identical to SEQ ID NO: 10950
  Pan degenerate oligonucleotide primer
  primer_bind (1)..(34)
  misc_feature (28)..(34): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10963 - DNA, 31 bp, Artificial Sequence; identical to SEQ ID NO: 10953
  Pan degenerate oligonucleotide primer
  primer_bind (1)..(31)
  misc_feature (25)..(31): Adaptor region of the pan degenerate antisense primer that adapts the probe-binding site downstream of codon 76 to correspond to the nucleotides in an oligonucleotide probe downstream of the discriminating single nucleotide polymorphism.

SEQ ID NO: 10964 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 76 to correspond to the nucleotides in an oligonucleotide probe downstream of the discriminating single nucleotide polymorphism.
aattatgttgayaggtgtrggyccyayya

SEQ ID NO: 10965 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 76 to correspond to the nucleotides in an oligonucleotide probe downstream of the discriminating single nucleotide polymorphism.
aakytgrgtcawcadrttyckyccaattatgttgryaggkgtrggtcctac

SEQ ID NO: 10966 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 76 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
adrttyckyccaattatgttgayaggtgtrggyccyayyan

SEQ ID NO: 10967 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 76 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ttyckyccaattatgttgayaggtgtrggyccyayyan

SEQ ID NO: 10968 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 76 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
yckyccaattatgttgayaggtgtrggyccyayyan

SEQ ID NO: 10969 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 76 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ckyccaattatgttgayaggtgtrggyccyayyan

SEQ ID NO: 10970 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 76 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ccaattatgttgayaggtgtrggyccyayyan

SEQ ID NO: 10971 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 76 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
aattatgttgayaggtgtrggyccyayyan

SEQ ID NO: 10972 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 76 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
aakytgrgtcawcadrttyckyccaattatgttgryaggkgtrggtcctacn

SEQ ID NO: 10973 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.
rcadccaakytgrgtcaacadrttyckyccaattatgttg

SEQ ID NO: 10974 - DNA, 40 bp, Artificial Sequence; identical to SEQ ID NO: 10973
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10975 - DNA, 40 bp, Artificial Sequence; identical to SEQ ID NO: 10973
  Pan degenerate oligonucleotide primer
  primer_bind (1)..(40)
  modified_base (2)..(2): base is a locked nucleic acid
  modified_base (3)..(3): base is a locked nucleic acid
  modified_base (9)..(9): base is a locked nucleic acid
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10976 - DNA, 38 bp, Artificial Sequence
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 82 to correspond to the nucleotides in an oligonucleotide probe downstream of the discriminating single nucleotide polymorphism.
adccaakytgrgtcaacadrttyckyccaattatgttg

SEQ ID NO: 10977 - DNA, 38 bp, Artificial Sequence; identical to SEQ ID NO: 10976
  Pan degenerate oligonucleotide primer
  primer_bind (1)..(38)
  modified_base (1)..(1): base is a locked nucleic acid
  modified_base (7)..(7): base is a locked nucleic acid
  modified_base (9)..(9): base is a locked nucleic acid
  misc_feature (32)..(38): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10978 - DNA, 38 bp, Artificial Sequence; identical to SEQ ID NO: 10976
  Pan degenerate oligonucleotide primer
  primer_bind (1)..(38)
  modified_base (1)..(1): base is a locked nucleic acid
  modified_base (4)..(4): base is a locked nucleic acid
  modified_base (9)..(9): base is a locked nucleic acid
  misc_feature (32)..(38): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10979 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 82 to correspond to the nucleotides in an oligonucleotide probe downstream of the discriminating single nucleotide polymorphism.
caakytgrgtcaacadrttyckyccaattatgttg

SEQ ID NO: 10980 - DNA, 35 bp, Artificial Sequence; identical to SEQ ID NO: 10979
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10981 - DNA, 35 bp, Artificial Sequence; identical to SEQ ID NO: 10979
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10982 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 82 to correspond to the nucleotides in an oligonucleotide probe downstream of the discriminating single nucleotide polymorphism.
kytgrgtcaacadrttyckyccaattatgttg

SEQ ID NO: 10983 - DNA, 32 bp, Artificial Sequence; identical to SEQ ID NO: 10982
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10984 - DNA, 32 bp, Artificial Sequence; identical to SEQ ID NO: 10982
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (26)..(32): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10985 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 82 to correspond to the nucleotides in an oligonucleotide probe downstream of the discriminating single nucleotide polymorphism.
tgrgtcaacadrttyckyccaattatgttg

SEQ ID NO: 10986 - DNA, 30 bp, Artificial Sequence; identical to SEQ ID NO: 10985
  Pan degenerate oligonucleotide primer
  primer_bind (1)..(30)
  modified_base (1)..(1): base is a locked nucleic acid
  modified_base (5)..(5): base is a locked nucleic acid
  modified_base (8)..(8): base is a locked nucleic acid
  misc_feature (24)..(30): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10987 - DNA, 30 bp, Artificial Sequence; identical to SEQ ID NO: 10985
  Pan degenerate oligonucleotide primer
  primer_bind (1)..(30)
  modified_base (1)..(1): base is a locked nucleic acid
  modified_base (2)..(2): base is a locked nucleic acid
  modified_base (8)..(8): base is a locked nucleic acid
  misc_feature (24)..(30): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10988 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
grgtcaacadrttyckyccaattatgttg

SEQ ID NO: 10989 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (10)..(10): base is a locked nucleic acid
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
grgtcaacadrttyckyccaattatgttg

SEQ ID NO: 10990 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (10)..(10): base is a locked nucleic acid
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
grgtcaacadrttyckyccaattatgttg

SEQ ID NO: 10991 - DNA, 40 bp, Artificial Sequence
  Pan degenerate oligonucleotide primer
  primer_bind (1)..(40)
  modified_base (3)..(3): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.
cadccaakytgrgtcaacadrttyckyccaattatgttga

SEQ ID NO: 10992 - DNA, 40 bp, Artificial Sequence; identical to SEQ ID NO: 10991
  Pan degenerate oligonucleotide primer
  primer_bind (1)..(40)
  modified_base (1)..(1): base is a locked nucleic acid
  modified_base (3)..(3): base is a locked nucleic acid
  modified_base (7)..(7): base is a locked nucleic acid
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10993 - DNA, 40 bp, Artificial Sequence; identical to SEQ ID NO: 10991
  Pan degenerate oligonucleotide primer
  primer_bind (1)..(40)
  modified_base (1)..(1): base is a locked nucleic acid
  modified_base (3)..(3): base is a locked nucleic acid
  modified_base (7)..(7): base is a locked nucleic acid
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10994 - DNA, 37 bp, Artificial Sequence
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 82 to correspond to the nucleotides in an oligonucleotide probe downstream of the discriminating single nucleotide polymorphism.
ccaakytgrgtcaacadrttyckyccaattatgttga

SEQ ID NO: 10995 - DNA, 37 bp, Artificial Sequence; identical to SEQ ID NO: 10994
  Pan degenerate oligonucleotide primer
  primer_bind (1)..(37)
  modified_base (1)..(1): base is a locked nucleic acid
  modified_base (7)..(7): base is a locked nucleic acid
  modified_base (9)..(9): base is a locked nucleic acid
  misc_feature (31)..(37): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10996 - DNA, 37 bp, Artificial Sequence; identical to SEQ ID NO: 10994
  Pan degenerate oligonucleotide primer
  primer_bind (1)..(37)
  modified_base (1)..(1): base is a locked nucleic acid
  modified_base (4)..(4): base is a locked nucleic acid
  modified_base (9)..(9): base is a locked nucleic acid
  misc_feature (31)..(37): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10997 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 82 to correspond to the nucleotides in an oligonucleotide probe downstream of the discriminating single nucleotide polymorphism.
akytgrgtcaacadrttyckyccaattatgttga

SEQ ID NO: 10998 - DNA, 34 bp, Artificial Sequence; identical to SEQ ID NO: 10997
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 10999 - DNA, 34 bp, Artificial Sequence; identical to SEQ ID NO: 10997
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11000 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 82 to correspond to the nucleotides in an oligonucleotide probe downstream of the discriminating single nucleotide polymorphism.
tgrgtcaacadrttyckyccaattatgttga

SEQ ID NO: 11001 - DNA, 31 bp, Artificial Sequence; identical to SEQ ID NO: 11000
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11002 - DNA, 31 bp, Artificial Sequence; identical to SEQ ID NO: 11000
  Pan degenerate oligonucleotide primer
  primer_bind (1)..(31)
  modified_base (1)..(1): base is a locked nucleic acid
  modified_base (3)..(3): base is a locked nucleic acid
  modified_base (7)..(7): base is a locked nucleic acid
  misc_feature (25)..(31): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11003 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
rgtcaacadrttyckyccaattatgttga

SEQ ID NO: 11004 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (8)..(8): base is a locked nucleic acid
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
rgtcaacadrttyckyccaattatgttga

SEQ ID NO: 11005 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (8)..(8): base is a locked nucleic acid
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
rgtcaacadrttyckyccaattatgttga

SEQ ID NO: 11006 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 82 to correspond to the nucleotides in an oligonucleotide probe downstream of the discriminating single nucleotide polymorphism.
gtcaacadrttyckyccaattatgttga

SEQ ID NO: 11007 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (10)..(10): base is a locked nucleic acid
  misc_feature (22)..(28): Adaptor region of the pan degenerate antisense primer that adapts the probe-binding site downstream of codon 82 to correspond to the nucleotides in an oligonucleotide probe downstream of the discriminating single nucleotide polymorphism.
gtcaacadrttyckyccaattatgttga

SEQ ID NO: 11008 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (10)..(10): base is a locked nucleic acid
  misc_feature (22)..(28): Adaptor region of the pan degenerate antisense primer that adapts the probe-binding site downstream of codon 82 to correspond to the nucleotides in an oligonucleotide probe downstream of the discriminating single nucleotide polymorphism.
gtcaacadrttyckyccaattatgttga

SEQ ID NO: 11009 - DNA, 40 bp, Artificial Sequence; identical to SEQ ID NO: 10973
  Pan degenerate oligonucleotide primer
  primer_bind (1)..(40)
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11010 - DNA, 38 bp, Artificial Sequence; identical to SEQ ID NO: 10976
  Pan degenerate oligonucleotide primer
  primer_bind (1)..(38)
  misc_feature (32)..(38): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11011 - DNA, 35 bp, Artificial Sequence; identical to SEQ ID NO: 10979
  Pan degenerate oligonucleotide primer
  primer_bind (1)..(35)
  misc_feature (29)..(35): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11012 - DNA, 32 bp, Artificial Sequence; identical to SEQ ID NO: 10982
  Pan degenerate oligonucleotide primer
  primer_bind (1)..(32)
  misc_feature (26)..(32): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11013 - DNA, 30 bp, Artificial Sequence; identical to SEQ ID NO: 10985
  Pan degenerate oligonucleotide primer
  primer_bind (1)..(30)
  misc_feature (24)..(30): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11014 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
grgtcaacadrttyckyccaattatgttg

SEQ ID NO: 11015 - DNA, 40 bp, Artificial Sequence; identical to SEQ ID NO: 10991
  Pan degenerate oligonucleotide primer
  primer_bind (1)..(40)
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11016 - DNA, 37 bp, Artificial Sequence; identical to SEQ ID NO: 10994
  Pan degenerate oligonucleotide primer
  primer_bind (1)..(37)
  misc_feature (31)..(37): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11017 - DNA, 34 bp, Artificial Sequence; identical to SEQ ID NO: 10997
  Pan degenerate oligonucleotide primer
  primer_bind (1)..(34)
  misc_feature (28)..(34): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11018 - DNA, 31 bp, Artificial Sequence; identical to SEQ ID NO: 11000
  Pan degenerate oligonucleotide primer
  primer_bind (1)..(31)
  misc_feature (25)..(31): Adaptor region of the pan degenerate antisense primer that adapts the probe-binding site downstream of codon 82 to correspond to the nucleotides in an oligonucleotide probe downstream of the discriminating single nucleotide polymorphism.

SEQ ID NO: 11019 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
rgtcaacadrttyckyccaattatgttga

SEQ ID NO: 11020 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 82 to correspond to the nucleotides in an oligonucleotide probe downstream of the discriminating single nucleotide polymorphism.
gtcaacadrttyckyccaattatgttga

SEQ ID NO: 11021 - DNA, 51 bp, Artificial Sequence
  Pan degenerate oligonucleotide primer
  primer_bind (1)..(51)
  misc_feature (16)..(16): n is a, c, g, or t
  misc_feature (45)..(51): Adaptor region of the pan degenerate antisense primer that adapts the probe-binding site downstream of codon 82 to correspond to the nucleotides in an oligonucleotide probe downstream of the discriminating single nucleotide polymorphism.
raaatttarwgtrcanccaakytgrgtcawcadrttyckyccaattatgtt

SEQ ID NO: 11022 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
rcadccaakytgrgtcaacadrttyckyccaattatgttgn

SEQ ID NO: 11023 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
adccaakytgrgtcaacadrttyckyccaattatgttgn

SEQ ID NO: 11024 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
caakytgrgtcaacadrttyckyccaattatgttgn

SEQ ID NO: 11025 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
kytgrgtcaacadrttyckyccaattatgttgn

SEQ ID NO: 11026 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tgrgtcaacadrttyckyccaattatgttgn

SEQ ID NO: 11027 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
grgtcaacadrttyckyccaattatgttgn

SEQ ID NO: 11028 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
cadccaakytgrgtcaacadrttyckyccaattatgttgan

SEQ ID NO: 11029 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ccaakytgrgtcaacadrttyckyccaattatgttgan

SEQ ID NO: 11030 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
akytgrgtcaacadrttyckyccaattatgttgan

SEQ ID NO: 11031 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
tgrgtcaacadrttyckyccaattatgttgan

SEQ ID NO: 11032 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
rgtcaacadrttyckyccaattatgttgan

SEQ ID NO: 11033 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
gtcaacadrttyckyccaattatgttgan

SEQ ID NO: 11034 - DNA, 52 bp, Artificial Sequence
  Pan degenerate oligonucleotide primer
  primer_bind (1)..(52)
  misc_feature (16)..(16): n is a, c, g, or t
  misc_feature (45)..(51): Adaptor region of the pan degenerate antisense primer that adapts the probe-binding site downstream of codon 82 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
raaatttarwgtrcanccaakytgrgtcawcadrttyckyccaattatgttn

SEQ ID NO: 11035 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 83 to correspond to the nucleotides in an oligonucleotide probe downstream of the discriminating single nucleotide polymorphism.
gtrcadccaakytgrgtcaacadrttyckyccaattatgt

SEQ ID NO: 11036 - DNA, 40 bp, Artificial Sequence; identical to SEQ ID NO: 11035
  Pan degenerate oligonucleotide primer
  primer_bind (1)..(40)
  modified_base (1)..(1): base is a locked nucleic acid
  modified_base (7)..(7): base is a locked nucleic acid
  modified_base (9)..(9): base is a locked nucleic acid
  misc_feature (34)..(40): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11037 - DNA, 40 bp, Artificial Sequence; identical to SEQ ID NO: 11035
  Pan degenerate oligonucleotide primer
  primer_bind (1)..(40)
  modified_base (1)..(1): base is a locked nucleic acid
  modified_base (4)..(4): base is a locked nucleic acid
  modified_base (9)..(9): base is a locked nucleic acid
  misc_feature (34)..(40): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11038 - DNA, 37 bp, Artificial Sequence
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 83 to correspond to the nucleotides in an oligonucleotide probe downstream of the discriminating single nucleotide polymorphism.
cadccaakytgrgtcaacadrttyckyccaattatgt

SEQ ID NO: 11039 - DNA, 37 bp, Artificial Sequence; identical to SEQ ID NO: 11038
  Pan degenerate oligonucleotide primer
  primer_bind (1)..(37)
  modified_base (1)..(1): base is a locked nucleic acid
  modified_base (6)..(6): base is a locked nucleic acid
  modified_base (7)..(7): base is a locked nucleic acid
  misc_feature (31)..(37): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11040 - DNA, 37 bp, Artificial Sequence; identical to SEQ ID NO: 11038
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11041 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 83 to correspond to the nucleotides in an oligonucleotide probe downstream of the discriminating single nucleotide polymorphism.
ccaakytgrgtcaacadrttyckyccaattatgt

SEQ ID NO: 11042 - DNA, 34 bp, Artificial Sequence; identical to SEQ ID NO: 11041
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11043 - DNA, 34 bp, Artificial Sequence; identical to SEQ ID NO: 11041
  Pan degenerate oligonucleotide primer
  primer_bind (1)..(34)
  modified_base (1)..(1): base is a locked nucleic acid
  modified_base (3)..(3): base is a locked nucleic acid
  modified_base (7)..(7): base is a locked nucleic acid
  misc_feature (28)..(34): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11044 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 83 to correspond to the nucleotides in an oligonucleotide probe downstream of the discriminating single nucleotide polymorphism.
aakytgrgtcaacadrttyckyccaattatgt

SEQ ID NO: 11045 - DNA, 32 bp, Artificial Sequence; identical to SEQ ID NO: 11044
  Pan degenerate oligonucleotide primer
  primer_bind (1)..(32)
  modified_base (1)..(1): base is a locked nucleic acid
  modified_base (5)..(5): base is a locked nucleic acid
  modified_base (8)..(8): base is a locked nucleic acid
  misc_feature (26)..(32): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11046 - DNA, 32 bp, Artificial Sequence; identical to SEQ ID NO: 11044
  Pan degenerate oligonucleotide primer
  primer_bind (1)..(32)
  modified_base (1)..(1): base is a locked nucleic acid
  modified_base (2)..(2): base is a locked nucleic acid
  modified_base (8)..(8): base is a locked nucleic acid
  misc_feature (26)..(32): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11047 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 83 to correspond to the nucleotides in an oligonucleotide probe downstream of the discriminating single nucleotide polymorphism.
akytgrgtcaacadrttyckyccaattatgt

SEQ ID NO: 11048 - DNA, 31 bp, Artificial Sequence; identical to SEQ ID NO: 11047
  Pan degenerate oligonucleotide primer
  primer_bind (1)..(31)
  modified_base (1)..(1): base is a locked nucleic acid
  modified_base (7)..(7): base is a locked nucleic acid
  modified_base (10)..(10): base is a locked nucleic acid
  misc_feature (25)..(31): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11049 - DNA, 31 bp, Artificial Sequence; identical to SEQ ID NO: 11047
  Pan degenerate oligonucleotide primer
  primer_bind (1)..(31)
  modified_base (1)..(1): base is a locked nucleic acid
  modified_base (4)..(4): base is a locked nucleic acid
  modified_base (10)..(10): base is a locked nucleic acid
  misc_feature (25)..(31): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11050 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 83 to correspond to the nucleotides in an oligonucleotide probe downstream of the discriminating single nucleotide polymorphism.
tgrgtcaacadrttyckyccaattatgt

SEQ ID NO: 11051 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (10)..(10): base is a locked nucleic acid
  misc_feature (22)..(28): Adaptor region of the pan degenerate antisense primer that adapts the probe-binding site downstream of codon 83 to correspond to the nucleotides in an oligonucleotide probe downstream of the discriminating single nucleotide polymorphism.
tgrgtcaacadrttyckyccaattatgt

SEQ ID NO: 11052 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (10)..(10): base is a locked nucleic acid
  misc_feature (22)..(28): Adaptor region of the pan degenerate antisense primer that adapts the probe-binding site downstream of codon 83 to correspond to the nucleotides in an oligonucleotide probe downstream of the discriminating single nucleotide polymorphism.
tgrgtcaacadrttyckyccaattatgt

SEQ ID NO: 11053 - DNA, 40 bp, Artificial Sequence; identical to SEQ ID NO: 11035
  Pan degenerate oligonucleotide primer
  primer_bind (1)..(40)
  misc_feature (34)..(40): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11054 - DNA, 37 bp, Artificial Sequence; identical to SEQ ID NO: 11038
  Pan degenerate oligonucleotide primer
  primer_bind (1)..(37)
  misc_feature (31)..(37): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11055 - DNA, 34 bp, Artificial Sequence; identical to SEQ ID NO: 11041
  Pan degenerate oligonucleotide primer
  primer_bind (1)..(34)
  misc_feature (28)..(34): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11056 - DNA, 32 bp, Artificial Sequence; identical to SEQ ID NO: 11044
  Pan degenerate oligonucleotide primer
  primer_bind (1)..(32)
  misc_feature (26)..(32): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11057 - DNA, 31 bp, Artificial Sequence; identical to SEQ ID NO: 11047
  Pan degenerate oligonucleotide primer
  primer_bind (1)..(31)
  misc_feature (25)..(31): Adaptor region of the pan degenerate antisense primer that adapts the probe-binding site downstream of codon 83 to correspond to the nucleotides in an oligonucleotide probe downstream of the discriminating single nucleotide polymorphism.

SEQ ID NO: 11058 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 83 to correspond to the nucleotides in an oligonucleotide probe downstream of the discriminating single nucleotide polymorphism.
tgrgtcaacadrttyckyccaattatgt

SEQ ID NO: 11059 - DNA, 50 bp, Artificial Sequence
  Pan degenerate oligonucleotide primer
  primer_bind (1)..(50)
  misc_feature (18)..(18): n is a, c, g, or t
  misc_feature (44)..(50): Adaptor region of the pan degenerate antisense primer that adapts the probe-binding site downstream of codon 83 to correspond to the nucleotides in an oligonucleotide probe downstream of the discriminating single nucleotide polymorphism.
ggraaatttarwgtrcanccaakytgrgtcawcadrttyckyccaattat

SEQ ID NO: 11060 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 83 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gtrcadccaakytgrgtcaacadrttyckyccaattatgtn

SEQ ID NO: 11061 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 83 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
cadccaakytgrgtcaacadrttyckyccaattatgtn

SEQ ID NO: 11062 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 83 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ccaakytgrgtcaacadrttyckyccaattatgtn

SEQ ID NO: 11063 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 83 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
aakytgrgtcaacadrttyckyccaattatgtn

SEQ ID NO: 11064 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 83 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
akytgrgtcaacadrttyckyccaattatgtn

SEQ ID NO: 11065 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 83 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tgrgtcaacadrttyckyccaattatgtn

SEQ ID NO: 11066 - DNA, 51 bp, Artificial Sequence
  Pan degenerate oligonucleotide primer
  primer_bind (1)..(51)
  misc_feature (18)..(18): n is a, c, g, or t
  misc_feature (44)..(50): Adaptor region of the pan degenerate antisense primer that adapts the probe-binding site downstream of codon 83 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
ggraaatttarwgtrcanccaakytgrgtcawcadrttyckyccaattatn

SEQ ID NO: 11067 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 84 to correspond to the nucleotides in an oligonucleotide probe downstream of the discriminating single nucleotide polymorphism.
arwgtrcadccaakytgrgtcaacadrttyckyccaatta

SEQ ID NO: 11068 - DNA, 40 bp, Artificial Sequence; identical to SEQ ID NO: 11067
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11069 - DNA, 40 bp, Artificial Sequence; identical to SEQ ID NO: 11067
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11070 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 84 to correspond to the nucleotides in an oligonucleotide probe downstream of the discriminating single nucleotide polymorphism.
gtrcadccaakytgrgtcaacadrttyckyccaatta

SEQ ID NO: 11071 - DNA, 37 bp, Artificial Sequence; identical to SEQ ID NO: 11070
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11072 - DNA, 37 bp, Artificial Sequence; identical to SEQ ID NO: 11070
  Pan degenerate oligonucleotide primer
  primer_bind (1)..(37)
  modified_base (1)..(1): base is a locked nucleic acid
  modified_base (3)..(3): base is a locked nucleic acid
  modified_base (7)..(7): base is a locked nucleic acid
  misc_feature (31)..(37): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11073 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 84 to correspond to the nucleotides in an oligonucleotide probe downstream of the discriminating single nucleotide polymorphism.
rcadccaakytgrgtcaacadrttyckyccaatta

SEQ ID NO: 11074 - DNA, 35 bp, Artificial Sequence; identical to SEQ ID NO: 11073
  Pan degenerate oligonucleotide primer
  primer_bind (1)..(35)
  modified_base (1)..(1): base is a locked nucleic acid
  modified_base (5)..(5): base is a locked nucleic acid
  modified_base (8)..(8): base is a locked nucleic acid
  misc_feature (29)..(35): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11075 - DNA, 35 bp, Artificial Sequence; identical to SEQ ID NO: 11073
  Pan degenerate oligonucleotide primer
  primer_bind (1)..(35)
  modified_base (1)..(1): base is a locked nucleic acid
  modified_base (2)..(2): base is a locked nucleic acid
  modified_base (8)..(8): base is a locked nucleic acid
  misc_feature (29)..(35): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11076 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 84 to correspond to the nucleotides in an oligonucleotide probe downstream of the discriminating single nucleotide polymorphism.
cadccaakytgrgtcaacadrttyckyccaatta

SEQ ID NO: 11077 - DNA, 34 bp, Artificial Sequence; identical to SEQ ID NO: 11076
  Pan degenerate oligonucleotide primer
  primer_bind (1)..(34)
  modified_base (1)..(1): base is a locked nucleic acid
  modified_base (7)..(7): base is a locked nucleic acid
  modified_base (10)..(10): base is a locked nucleic acid
  misc_feature (28)..(34): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11078 - DNA, 34 bp, Artificial Sequence; identical to SEQ ID NO: 11076
  Pan degenerate oligonucleotide primer
  primer_bind (1)..(34)
  modified_base (1)..(1): base is a locked nucleic acid
  modified_base (4)..(4): base is a locked nucleic acid
  modified_base (10)..(10): base is a locked nucleic acid
  misc_feature (28)..(34): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11079 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 84 to correspond to the nucleotides in an oligonucleotide probe downstream of the discriminating single nucleotide polymorphism.
ccaakytgrgtcaacadrttyckyccaatta

SEQ ID NO: 11080 - DNA, 31 bp, Artificial Sequence; identical to SEQ ID NO: 11079
  Pan degenerate oligonucleotide primer
  primer_bind (1)..(31)
  modified_base (1)..(1): base is a locked nucleic acid
  modified_base (7)..(7): base is a locked nucleic acid
  modified_base (10)..(10): base is a locked nucleic acid
  misc_feature (25)..(31): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11081 - DNA, 31 bp, Artificial Sequence; identical to SEQ ID NO: 11079
  Pan degenerate oligonucleotide primer
  primer_bind (1)..(31)
  modified_base (1)..(1): base is a locked nucleic acid
  modified_base (4)..(4): base is a locked nucleic acid
  modified_base (10)..(10): base is a locked nucleic acid
  misc_feature (25)..(31): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11082 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 84 to correspond to the nucleotides in an oligonucleotide probe downstream of the discriminating single nucleotide polymorphism.
akytgrgtcaacadrttyckyccaatta

SEQ ID NO: 11083 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (13)..(13): base is a locked nucleic acid
  misc_feature (22)..(28): Adaptor region of the pan degenerate antisense primer that adapts the probe-binding site downstream of codon 84 to correspond to the nucleotides in an oligonucleotide probe downstream of the discriminating single nucleotide polymorphism.
akytgrgtcaacadrttyckyccaatta

SEQ ID NO: 11084 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (13)..(13): base is a locked nucleic acid
  misc_feature (22)..(28): Adaptor region of the pan degenerate antisense primer that adapts the probe-binding site downstream of codon 84 to correspond to the nucleotides in an oligonucleotide probe downstream of the discriminating single nucleotide polymorphism.
akytgrgtcaacadrttyckyccaatta

SEQ ID NO: 11085 - DNA, 40 bp, Artificial Sequence; identical to SEQ ID NO: 11067
  Pan degenerate oligonucleotide primer
  primer_bind (1)..(40)
  misc_feature (34)..(40): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11086 - DNA, 37 bp, Artificial Sequence; identical to SEQ ID NO: 11070
  Pan degenerate oligonucleotide primer
  primer_bind (1)..(37)
  misc_feature (31)..(37): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11087 - DNA, 35 bp, Artificial Sequence; identical to SEQ ID NO: 11073
  Pan degenerate oligonucleotide primer
  primer_bind (1)..(35)
  misc_feature (29)..(35): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11088 - DNA, 34 bp, Artificial Sequence; identical to SEQ ID NO: 11076
  Pan degenerate oligonucleotide primer
  primer_bind (1)..(34)
  misc_feature (28)..(34): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11089 - DNA, 31 bp, Artificial Sequence; identical to SEQ ID NO: 11079
  Pan degenerate oligonucleotide primer
  primer_bind (1)..(31)
  misc_feature (25)..(31): Adaptor region of the pan degenerate antisense primer that adapts the probe-binding site downstream of codon 84 to correspond to the nucleotides in an oligonucleotide probe downstream of the discriminating single nucleotide polymorphism.

SEQ ID NO: 11090 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 84 to correspond to the nucleotides in an oligonucleotide probe downstream of the discriminating single nucleotide polymorphism.
akytgrgtcaacadrttyckyccaatta

SEQ ID NO: 11091 - DNA, 51 bp, Artificial Sequence
  Pan degenerate oligonucleotide primer
  primer_bind (1)..(51)
  misc_feature (22)..(22): n is a, c, g, or t
  misc_feature (45)..(51): Adaptor region of the pan degenerate antisense primer that adapts the probe-binding site downstream of codon 84 to correspond to the nucleotides in an oligonucleotide probe downstream of the discriminating single nucleotide polymorphism.
ratkggraaatttarwgtrcanccaakytgrgtcawcadrttycktccaat

SEQ ID NO: 11092 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 84 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
arwgtrcadccaakytgrgtcaacadrttyckyccaattan

SEQ ID NO: 11093 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 84 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
gtrcadccaakytgrgtcaacadrttyckyccaattan

SEQ ID NO: 11094 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 84 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
rcadccaakytgrgtcaacadrttyckyccaattan

SEQ ID NO: 11095 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 84 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
cadccaakytgrgtcaacadrttyckyccaattan

SEQ ID NO: 11096 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 84 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ccaakytgrgtcaacadrttyckyccaattan

SEQ ID NO: 11097 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 84 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
akytgrgtcaacadrttyckyccaattan

SEQ ID NO: 11098 - DNA, 52 bp, Artificial Sequence
  Pan degenerate oligonucleotide primer
  primer_bind (1)..(52)
  misc_feature (22)..(22): n is a, c, g, or t
  misc_feature (45)..(51): Adaptor region of the pan degenerate antisense primer that adapts the probe-binding site downstream of codon 84 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ratkggraaatttarwgtrcanccaakytgrgtcawcadrttycktccaatn

SEQ ID NO: 11099 - DNA, 40 bp, Artificial Sequence
  Pan degenerate oligonucleotide primer
  primer_bind (1)..(40)
  modified_base (3)..(3): base is a locked nucleic acid
  modified_base (6)..(6): base is a locked nucleic acid
  modified_base (12)..(12): base is a locked nucleic acid
  misc_feature (34)..(40): Adaptor region of the pan degenerate antisense primer that adapts the probe-binding site downstream of codon 88 to correspond to the nucleotides in an oligonucleotide probe downstream of the discriminating single nucleotide polymorphism.
datkggraaatttarwgtrcadccaakytgrgtcaacadr

SEQ ID NO: 11100 - DNA, 40 bp, Artificial Sequence; identical to SEQ ID NO: 11099
  Pan degenerate oligonucleotide primer
  primer_bind (1)..(40)
  modified_base (3)..(3): base is a locked nucleic acid
  modified_base (12)..(12): base is a locked nucleic acid
  modified_base (15)..(15): base is a locked nucleic acid
  misc_feature (34)..(40): Adaptor region of the pan degenerate antisense primer that adapts the probe-binding site downstream of codon 88 to correspond to the nucleotides in an oligonucleotide probe downstream of the discriminating single nucleotide polymorphism.

SEQ ID NO: 11101 - DNA, 40 bp, Artificial Sequence; identical to SEQ ID NO: 11099
  Pan degenerate oligonucleotide primer
  primer_bind (1)..(40)
  modified_base (3)..(3): base is a locked nucleic acid
  modified_base (6)..(6): base is a locked nucleic acid
  modified_base (15)..(15): base is a locked nucleic acid
  misc_feature (34)..(40): Adaptor region of the pan degenerate antisense primer that adapts the probe-binding site downstream of codon 88 to correspond to the nucleotides in an oligonucleotide probe downstream of the discriminating single nucleotide polymorphism.

SEQ ID NO: 11102 - DNA, 35 bp, Artificial Sequence
  Pan degenerate oligonucleotide primer
  primer_bind (1)..(35)
  modified_base (1)..(1): base is a locked nucleic acid
  modified_base (7)..(7): base is a locked nucleic acid
  modified_base (10)..(10): base is a locked nucleic acid
  misc_feature (29)..(35): Adaptor region of the pan degenerate antisense primer that adapts the probe-binding site downstream of codon 88 to correspond to the nucleotides in an oligonucleotide probe downstream of the discriminating single nucleotide polymorphism.
graaatttarwgtrcadccaakytgrgtcaacadr

SEQ ID NO: 11103 - DNA, 35 bp, Artificial Sequence; identical to SEQ ID NO: 11102
  Pan degenerate oligonucleotide primer
  primer_bind (1)..(35)
  modified_base (1)..(1): base is a locked nucleic acid
  modified_base (10)..(10): base is a locked nucleic acid
  modified_base (12)..(12): base is a locked nucleic acid
  misc_feature (29)..(35): Adaptor region of the pan degenerate antisense primer that adapts the probe-binding site downstream of codon 88 to correspond to the nucleotides in an oligonucleotide probe downstream of the discriminating single nucleotide polymorphism.

SEQ ID NO: 11104 - DNA, 35 bp, Artificial Sequence; identical to SEQ ID NO: 11102
  Pan degenerate oligonucleotide primer
  primer_bind (1)..(35)
  modified_base (1)..(1): base is a locked nucleic acid
  modified_base (7)..(7): base is a locked nucleic acid
  modified_base (12)..(12): base is a locked nucleic acid
  misc_feature (29)..(35): Adaptor region of the pan degenerate antisense primer that adapts the probe-binding site downstream of codon 88 to correspond to the nucleotides in an oligonucleotide probe downstream of the discriminating single nucleotide polymorphism.

SEQ ID NO: 11105 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate antisense primer that adapts the probe-binding site downstream of codon 88 to correspond to the nucleotides in an oligonucleotide probe downstream of the discriminating single nucleotide polymorphism.
ttarwgtrcadccaakytgrgtcaacadr

SEQ ID NO: 11106 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate antisense primer that adapts the probe-binding site downstream of codon 88 to correspond to the nucleotides in an oligonucleotide probe downstream of the discriminating single nucleotide polymorphism.
ttarwgtrcadccaakytgrgtcaacadr

SEQ ID NO: 11107 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate antisense primer that adapts the probe-binding site downstream of codon 88 to correspond to the nucleotides in an oligonucleotide probe downstream of the discriminating single nucleotide polymorphism.
ttarwgtrcadccaakytgrgtcaacadr

SEQ ID NO: 11108 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate antisense primer that adapts the probe-binding site downstream of codon 88 to correspond to the nucleotides in an oligonucleotide probe downstream of the discriminating single nucleotide polymorphism.
rwgtrcadccaakytgrgtcaacadr

SEQ ID NO: 11109 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (6)..(6): base is a locked nucleic acid
  misc_feature (20)..(26): Adaptor region of the pan degenerate antisense primer that adapts the probe-binding site downstream of codon 88 to correspond to the nucleotides in an oligonucleotide probe downstream of the discriminating single nucleotide polymorphism.
rwgtrcadccaakytgrgtcaacadr

SEQ ID NO: 11110 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (6)..(6): base is a locked nucleic acid
  misc_feature (20)..(26): Adaptor region of the pan degenerate antisense primer that adapts the probe-binding site downstream of codon 88 to correspond to the nucleotides in an oligonucleotide probe downstream of the discriminating single nucleotide polymorphism.
rwgtrcadccaakytgrgtcaacadr

SEQ ID NO: 11111 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate antisense primer that adapts the probe-binding site downstream of codon 88 to correspond to the nucleotides in an oligonucleotide probe downstream of the discriminating single nucleotide polymorphism.
gtrcadccaakytgrgtcaacadr

SEQ ID NO: 11112 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (5)..(5): base is a locked nucleic acid
  misc_feature (18)..(24): Adaptor region of the pan degenerate antisense primer that adapts the probe-binding site downstream of codon 88 to correspond to the nucleotides in an oligonucleotide probe downstream of the discriminating single nucleotide polymorphism.
gtrcadccaakytgrgtcaacadr

SEQ ID NO: 11113 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (5)..(5): base is a locked nucleic acid
  misc_feature (18)..(24): Adaptor region of the pan degenerate antisense primer that adapts the probe-binding site downstream of codon 88 to correspond to the nucleotides in an oligonucleotide probe downstream of the discriminating single nucleotide polymorphism.
gtrcadccaakytgrgtcaacadr

SEQ ID NO: 11114 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (4)..(4): base is a locked nucleic acid
  misc_feature (17)..(23): Adaptor region of the pan degenerate antisense primer that adapts the probe-binding site downstream of codon 88 to correspond to the nucleotides in an oligonucleotide probe downstream of the discriminating single nucleotide polymorphism.
trcadccaakytgrgtcaacadr

SEQ ID NO: 11115 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (6)..(6): base is a locked nucleic acid
  misc_feature (17)..(23): Adaptor region of the pan degenerate antisense primer that adapts the probe-binding site downstream of codon 88 to correspond to the nucleotides in an oligonucleotide probe downstream of the discriminating single nucleotide polymorphism.
trcadccaakytgrgtcaacadr

SEQ ID NO: 11116 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (6)..(6): base is a locked nucleic acid
  misc_feature (17)..(23): Adaptor region of the pan degenerate antisense primer that adapts the probe-binding site downstream of codon 88 to correspond to the nucleotides in an oligonucleotide probe downstream of the discriminating single nucleotide polymorphism.
trcadccaakytgrgtcaacadr

SEQ ID NO: 11117 - DNA, 40 bp, Artificial Sequence; identical to SEQ ID NO: 11099
  Pan degenerate oligonucleotide primer
  primer_bind (1)..(40)
  misc_feature (34)..(40): Adaptor region of the pan degenerate antisense primer that adapts the probe-binding site downstream of codon 88 to correspond to the nucleotides in an oligonucleotide probe downstream of the discriminating single nucleotide polymorphism.

SEQ ID NO: 11118 - DNA, 35 bp, Artificial Sequence; identical to SEQ ID NO: 11102
  Pan degenerate oligonucleotide primer
  primer_bind (1)..(35)
  misc_feature (29)..(35): Adaptor region of the pan degenerate antisense primer that adapts the probe-binding site downstream of codon 88 to correspond to the nucleotides in an oligonucleotide probe downstream of the discriminating single nucleotide polymorphism.

SEQ ID NO: 11119 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 88 to correspond to the nucleotides in an oligonucleotide probe downstream of the discriminating single nucleotide polymorphism.
ttarwgtrcadccaakytgrgtcaacadr

SEQ ID NO: 11120 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 88 to correspond to the nucleotides in an oligonucleotide probe downstream of the discriminating single nucleotide polymorphism.
rwgtrcadccaakytgrgtcaacadr

SEQ ID NO: 11121 - DNA, 24 bp, Artificial Sequence
  Pan degenerate oligonucleotide primer
  primer_bind (1)..(24)
  misc_feature (18)..(24): Adaptor region of the pan degenerate antisense primer that adapts the probe-binding site downstream of codon 88 to correspond to the nucleotides in an oligonucleotide probe downstream of the discriminating single nucleotide polymorphism.
gtrcadccaakytgrgtcaacadr

SEQ ID NO: 11122 - DNA, 23 bp, Artificial Sequence
  Pan degenerate oligonucleotide primer
  primer_bind (1)..(23)
  misc_feature (17)..(23): Adaptor region of the pan degenerate antisense primer that adapts the probe-binding site downstream of codon 88 to correspond to the nucleotides in an oligonucleotide probe downstream of the discriminating single nucleotide polymorphism.
trcadccaakytgrgtcaacadr

SEQ ID NO: 11123 - DNA, 50 bp, Artificial Sequence
  Pan degenerate oligonucleotide primer
  primer_bind (1)..(50)
  misc_feature (33)..(33): n is a, c, g, or t
  misc_feature (44)..(50): Adaptor region of the pan degenerate antisense primer that adapts the probe-binding site downstream of codon 88 to correspond to the nucleotides in an oligonucleotide probe downstream of the discriminating single nucleotide polymorphism.
tcaatrggrctratkggraaatttarwgtrcanccaakytgrgtcaacag

SEQ ID NO: 11124 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 88 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
datkggraaatttarwgtrcadccaakytgrgtcaacadrn

SEQ ID NO: 11125 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 88 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
graaatttarwgtrcadccaakytgrgtcaacadrn

SEQ ID NO: 11126 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 88 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
ttarwgtrcadccaakytgrgtcaacadrn

SEQ ID NO: 11127 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 88 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
rwgtrcadccaakytgrgtcaacadrn

SEQ ID NO: 11128 - DNA, 25 bp, Artificial Sequence
  Pan degenerate oligonucleotide primer
  primer_bind (1)..(25)
  misc_feature (18)..(24): Adaptor region of the pan degenerate antisense primer that adapts the probe-binding site downstream of codon 88 to correspond to the nucleotides in an oligonucleotide probe downstream of the discriminating single nucleotide polymorphism.
  modified_base (25)..(25): base is a locked nucleic acid
  misc_feature (25)..(25): n is a, c, g, or t
gtrcadccaakytgrgtcaacadrn

SEQ ID NO: 11129 - DNA, 24 bp, Artificial Sequence
  Pan degenerate oligonucleotide primer
  primer_bind (1)..(24)
  misc_feature (17)..(23): Adaptor region of the pan degenerate antisense primer that adapts the probe-binding site downstream of codon 88 to correspond to the nucleotides in an oligonucleotide probe downstream of the discriminating single nucleotide polymorphism.
  modified_base (24)..(24): base is a locked nucleic acid
  misc_feature (24)..(24): n is a, c, g, or t
trcadccaakytgrgtcaacadrn

SEQ ID NO: 11130 - DNA, 51 bp, Artificial Sequence
  Pan degenerate oligonucleotide primer
  primer_bind (1)..(51)
  misc_feature (33)..(33): n is a, c, g, or t
  misc_feature (44)..(50): Adaptor region of the pan degenerate antisense primer that adapts the probe-binding site downstream of codon 88 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
tcaatrggrctratkggraaatttarwgtrcanccaakytgrgtcaacagn

SEQ ID NO: 11131 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (10)..(10): base is a locked nucleic acid
  misc_feature (34)..(40): Adaptor region of the pan degenerate antisense primer that adapts the probe-binding site downstream of codon 89 to correspond to the nucleotides in an oligonucleotide probe downstream of the discriminating single nucleotide polymorphism.
ctdatkggraaatttarwgtrcadccaakytgrgtcaaca

SEQ ID NO: 11132 - DNA, 40 bp, Artificial Sequence; identical to SEQ ID NO: 11131
  Pan degenerate oligonucleotide primer
  primer_bind (1)..(40)
  modified_base (1)..(1): base is a locked nucleic acid
  modified_base (10)..(10): base is a locked nucleic acid
  modified_base (13)..(13): base is a locked nucleic acid
  misc_feature (34)..(40): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11133 - DNA, 40 bp, Artificial Sequence; identical to SEQ ID NO: 11131
  Pan degenerate oligonucleotide primer
  primer_bind (1)..(40)
  modified_base (1)..(1): base is a locked nucleic acid
  modified_base (4)..(4): base is a locked nucleic acid
  modified_base (13)..(13): base is a locked nucleic acid
  misc_feature (34)..(40): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11134 - DNA, 37 bp, Artificial Sequence
  Pan degenerate oligonucleotide primer
  primer_bind (1)..(37)
  modified_base (1)..(1): base is a locked nucleic acid
  modified_base (7)..(7): base is a locked nucleic acid
  modified_base (10)..(10): base is a locked nucleic acid
  misc_feature (31)..(37): Adaptor region of the pan degenerate antisense primer that adapts the probe-binding site downstream of codon 89 to correspond to the nucleotides in an oligonucleotide probe downstream of the discriminating single nucleotide polymorphism.
atkggraaatttarwgtrcadccaakytgrgtcaaca

SEQ ID NO: 11135 - DNA, 37 bp, Artificial Sequence; identical to SEQ ID NO: 11134
  Pan degenerate oligonucleotide primer
  primer_bind (1)..(37)
  modified_base (1)..(1): base is a locked nucleic acid
  modified_base (10)..(10): base is a locked nucleic acid
  modified_base (12)..(12): base is a locked nucleic acid
  misc_feature (31)..(37): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11136 - DNA, 37 bp, Artificial Sequence; identical to SEQ ID NO: 11134
  Pan degenerate oligonucleotide primer
  primer_bind (1)..(37)
  modified_base (1)..(1): base is a locked nucleic acid
  modified_base (7)..(7): base is a locked nucleic acid
  modified_base (12)..(12): base is a locked nucleic acid
  misc_feature (31)..(37): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11137 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 89 to correspond to the nucleotides in an oligonucleotide probe downstream of the discriminating single nucleotide polymorphism.
aaatttarwgtrcadccaakytgrgtcaaca

SEQ ID NO: 11138 - DNA, 31 bp, Artificial Sequence; identical to SEQ ID NO: 11137
  Pan degenerate oligonucleotide primer
  primer_bind (1)..(31)
  modified_base (1)..(1): base is a locked nucleic acid
  modified_base (6)..(6): base is a locked nucleic acid
  modified_base (7)..(7): base is a locked nucleic acid
  misc_feature (25)..(31): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11139 - DNA, 31 bp, Artificial Sequence; identical to SEQ ID NO: 11137
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11140 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 89 to correspond to the nucleotides in an oligonucleotide probe downstream of the discriminating single nucleotide polymorphism.
tttarwgtrcadccaakytgrgtcaaca

SEQ ID NO: 11141 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 89 to correspond to the nucleotides in an oligonucleotide probe downstream of the discriminating single nucleotide polymorphism.
tttarwgtrcadccaakytgrgtcaaca

SEQ ID NO: 11142 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (6)..(6): base is a locked nucleic acid
  misc_feature (22)..(28): Adaptor region of the pan degenerate antisense primer that adapts the probe-binding site downstream of codon 89 to correspond to the nucleotides in an oligonucleotide probe downstream of the discriminating single nucleotide polymorphism.
tttarwgtrcadccaakytgrgtcaaca

SEQ ID NO: 11143 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (4)..(4): base is a locked nucleic acid
  misc_feature (20)..(26): Adaptor region of the pan degenerate antisense primer that adapts the probe-binding site downstream of codon 89 to correspond to the nucleotides in an oligonucleotide probe downstream of the discriminating single nucleotide polymorphism.
tarwgtrcadccaakytgrgtcaaca

SEQ ID NO: 11144 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (5)..(5): base is a locked nucleic acid
  misc_feature (20)..(26): Adaptor region of the pan degenerate antisense primer that adapts the probe-binding site downstream of codon 89 to correspond to the nucleotides in an oligonucleotide probe downstream of the discriminating single nucleotide polymorphism.
tarwgtrcadccaakytgrgtcaaca

SEQ ID NO: 11145 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (5)..(5): base is a locked nucleic acid
  misc_feature (20)..(26): Adaptor region of the pan degenerate antisense primer that adapts the probe-binding site downstream of codon 89 to correspond to the nucleotides in an oligonucleotide probe downstream of the discriminating single nucleotide polymorphism.
tarwgtrcadccaakytgrgtcaaca

SEQ ID NO: 11146 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (4)..(4): base is a locked nucleic acid
  misc_feature (19)..(25): Adaptor region of the pan degenerate antisense primer that adapts the probe-binding site downstream of codon 89 to correspond to the nucleotides in an oligonucleotide probe downstream of the discriminating single nucleotide polymorphism.
arwgtrcadccaakytgrgtcaaca

SEQ ID NO: 11147 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (6)..(6): base is a locked nucleic acid
  misc_feature (19)..(25): Adaptor region of the pan degenerate antisense primer that adapts the probe-binding site downstream of codon 89 to correspond to the nucleotides in an oligonucleotide probe downstream of the discriminating single nucleotide polymorphism.
arwgtrcadccaakytgrgtcaaca

SEQ ID NO: 11148 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (6)..(6): base is a locked nucleic acid
  misc_feature (19)..(25): Adaptor region of the pan degenerate antisense primer that adapts the probe-binding site downstream of codon 89 to correspond to the nucleotides in an oligonucleotide probe downstream of the discriminating single nucleotide polymorphism.
arwgtrcadccaakytgrgtcaaca

SEQ ID NO: 11149 - DNA, 40 bp, Artificial Sequence; identical to SEQ ID NO: 11131
  Pan degenerate oligonucleotide primer
  primer_bind (1)..(40)
  misc_feature (34)..(40): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11150 - DNA, 37 bp, Artificial Sequence; identical to SEQ ID NO: 11134
  Pan degenerate oligonucleotide primer
  primer_bind (1)..(37)
  misc_feature (31)..(37): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11151 - DNA, 31 bp, Artificial Sequence; identical to SEQ ID NO: 11137
  Pan degenerate oligonucleotide primer
  primer_bind (1)..(31)
  misc_feature (25)..(31): Adaptor region of the pan degenerate antisense primer that adapts the probe-binding site downstream of codon 89 to correspond to the nucleotides in an oligonucleotide probe downstream of the discriminating single nucleotide polymorphism.

SEQ ID NO: 11152 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 89 to correspond to the nucleotides in an oligonucleotide probe downstream of the discriminating single nucleotide polymorphism.
tttarwgtrcadccaakytgrgtcaaca

SEQ ID NO: 11153 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 89 to correspond to the nucleotides in an oligonucleotide probe downstream of the discriminating single nucleotide polymorphism.
tarwgtrcadccaakytgrgtcaaca

SEQ ID NO: 11154 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 89 to correspond to the nucleotides in an oligonucleotide probe downstream of the discriminating single nucleotide polymorphism.
arwgtrcadccaakytgrgtcaaca

SEQ ID NO: 11155 - DNA, 50 bp, Artificial Sequence
  Pan degenerate oligonucleotide primer
  primer_bind (1)..(50)
  misc_feature (36)..(36): n is a, c, g, or t
  misc_feature (44)..(50): Adaptor region of the pan degenerate antisense primer that adapts the probe-binding site downstream of codon 89 to correspond to the nucleotides in an oligonucleotide probe downstream of the discriminating single nucleotide polymorphism.
gtbtcaatrggrctratkggraaatttarwgtrcanccaakytgrgtcaa

SEQ ID NO: 11156 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 89 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ctdatkggraaatttarwgtrcadccaakytgrgtcaacan

SEQ ID NO: 11157 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 89 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
atkggraaatttarwgtrcadccaakytgrgtcaacan

SEQ ID NO: 11158 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 89 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
aaatttarwgtrcadccaakytgrgtcaacan

SEQ ID NO: 11159 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 89 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tttarwgtrcadccaakytgrgtcaacan

SEQ ID NO: 11160 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 89 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
tarwgtrcadccaakytgrgtcaacan

SEQ ID NO: 11161 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 89 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
arwgtrcadccaakytgrgtcaacan

SEQ ID NO: 11162 - DNA, 51 bp, Artificial Sequence
  Pan degenerate oligonucleotide primer
  primer_bind (1)..(51)
  misc_feature (36)..(36): n is a, c, g, or t
  misc_feature (44)..(50): Adaptor region of the pan degenerate antisense primer that adapts the probe-binding site downstream of codon 89 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
gtbtcaatrggrctratkggraaatttarwgtrcanccaakytgrgtcaan

SEQ ID NO: 11163 - DNA, 40 bp, Artificial Sequence
  Pan degenerate oligonucleotide primer
  primer_bind (1)..(40)
  modified_base (1)..(1): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.
ggrctdatkggraaatttarwgtrcadccaakytgrgtca

SEQ ID NO: 11164 - DNA, 40 bp, Artificial Sequence; identical to SEQ ID NO: 11163
  Pan degenerate oligonucleotide primer
  primer_bind (1)..(40)
  modified_base (10)..(10): base is a locked nucleic acid
  modified_base (12)..(12): base is a locked nucleic acid
  modified_base (13)..(13): base is a locked nucleic acid
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11165 - DNA, 40 bp, Artificial Sequence; identical to SEQ ID NO: 11163
  Pan degenerate oligonucleotide primer
  primer_bind (1)..(40)
  modified_base (7)..(7): base is a locked nucleic acid
  modified_base (10)..(10): base is a locked nucleic acid
  modified_base (13)..(13): base is a locked nucleic acid
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11166 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.
atkggraaatttarwgtrcadccaakytgrgtca

SEQ ID NO: 11167 - DNA, 34 bp, Artificial Sequence; identical to SEQ ID NO: 11166
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11168 - DNA, 34 bp, Artificial Sequence; identical to SEQ ID NO: 11166
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11169 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.
ggraaatttarwgtrcadccaakytgrgtca

SEQ ID NO: 11170 - DNA, 31 bp, Artificial Sequence; identical to SEQ ID NO: 11169
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11171 - DNA, 31 bp, Artificial Sequence; identical to SEQ ID NO: 11169
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11172 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 90 to correspond to the nucleotides in an oligonucleotide probe downstream of the discriminating single nucleotide polymorphism.
raaatttarwgtrcadccaakytgrgtca

SEQ ID NO: 11173 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 90 to correspond to the nucleotides in an oligonucleotide probe downstream of the discriminating single nucleotide polymorphism.
raaatttarwgtrcadccaakytgrgtca

SEQ ID NO: 11174 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 90 to correspond to the nucleotides in an oligonucleotide probe downstream of the discriminating single nucleotide polymorphism.
raaatttarwgtrcadccaakytgrgtca

SEQ ID NO: 11175 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 90 to correspond to the nucleotides in an oligonucleotide probe downstream of the discriminating single nucleotide polymorphism.
aaatttarwgtrcadccaakytgrgtca

SEQ ID NO: 11176 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 90 to correspond to the nucleotides in an oligonucleotide probe downstream of the discriminating single nucleotide polymorphism.
aaatttarwgtrcadccaakytgrgtca

SEQ ID NO: 11177 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (6)..(6): base is a locked nucleic acid
  misc_feature (22)..(28): Adaptor region of the pan degenerate antisense primer that adapts the probe-binding site downstream of codon 90 to correspond to the nucleotides in an oligonucleotide probe downstream of the discriminating single nucleotide polymorphism.
aaatttarwgtrcadccaakytgrgtca

SEQ ID NO: 11178 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (4)..(4): base is a locked nucleic acid
  misc_feature (20)..(26): Adaptor region of the pan degenerate antisense primer that adapts the probe-binding site downstream of codon 90 to correspond to the nucleotides in an oligonucleotide probe downstream of the discriminating single nucleotide polymorphism.
atttarwgtrcadccaakytgrgtca

SEQ ID NO: 11179 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (5)..(5): base is a locked nucleic acid
  misc_feature (20)..(26): Adaptor region of the pan degenerate antisense primer that adapts the probe-binding site downstream of codon 90 to correspond to the nucleotides in an oligonucleotide probe downstream of the discriminating single nucleotide polymorphism.
atttarwgtrcadccaakytgrgtca

SEQ ID NO: 11180 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (5)..(5): base is a locked nucleic acid
  misc_feature (20)..(26): Adaptor region of the pan degenerate antisense primer that adapts the probe-binding site downstream of codon 90 to correspond to the nucleotides in an oligonucleotide probe downstream of the discriminating single nucleotide polymorphism.
atttarwgtrcadccaakytgrgtca

SEQ ID NO: 11181 - DNA, 40 bp, Artificial Sequence; identical to SEQ ID NO: 11163
  Pan degenerate oligonucleotide primer
  primer_bind (1)..(40)
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11182 - DNA, 34 bp, Artificial Sequence; identical to SEQ ID NO: 11166
  Pan degenerate oligonucleotide primer
  primer_bind (1)..(34)
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11183 - DNA, 31 bp, Artificial Sequence; identical to SEQ ID NO: 11169
  Pan degenerate oligonucleotide primer
  primer_bind (1)..(31)
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 11184 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 90 to correspond to the nucleotides in an oligonucleotide probe downstream of the discriminating single nucleotide polymorphism.
raaatttarwgtrcadccaakytgrgtca

SEQ ID NO: 11185 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 90 to correspond to the nucleotides in an oligonucleotide probe downstream of the discriminating single nucleotide polymorphism.
aaatttarwgtrcadccaakytgrgtca

SEQ ID NO: 11186 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 90 to correspond to the nucleotides in an oligonucleotide probe downstream of the discriminating single nucleotide polymorphism.
atttarwgtrcadccaakytgrgtca

SEQ ID NO: 11187 - DNA, 50 bp, Artificial Sequence
  Pan degenerate oligonucleotide primer
  primer_bind (1)..(50)
  misc_feature (39)..(39): n is a, c, g, or t
  misc_feature (44)..(50): Adaptor region of the pan degenerate antisense primer that adapts the probe-binding site downstream of codon 90 to correspond to the nucleotides in an oligonucleotide probe downstream of the discriminating single nucleotide polymorphism.
acagtbtcaatrggrctratkggraaatttarwgtrcanccaakytgagt

SEQ ID NO: 11188 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ggrctdatkggraaatttarwgtrcadccaakytgrgtcan

SEQ ID NO: 11189 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
atkggraaatttarwgtrcadccaakytgrgtcan

SEQ ID NO: 11190 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ggraaatttarwgtrcadccaakytgrgtcan

SEQ ID NO: 11191 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
raaatttarwgtrcadccaakytgrgtcan

SEQ ID NO: 11192 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
aaatttarwgtrcadccaakytgrgtcan

SEQ ID NO: 11193 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
atttarwgtrcadccaakytgrgtcan

SEQ ID NO: 11194 - DNA, 51 bp, Artificial Sequence
  Pan degenerate oligonucleotide primer
  primer_bind (1)..(51)
  misc_feature (39)..(39): n is a, c, g, or t
  misc_feature (44)..(50): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
acagtbtcaatrggrctratkggraaatttarwgtrcanccaakytgagtn

SEQ ID NO: 11195 - DNA, 15 bp, Artificial Sequence
  Oligonucleotide probe
  misc_binding (1)..(15): Hybridization probe for the specific detection of wild-type HIV-1 at codon 10 of the protease gene.
cgaccccthgtcaca

SEQ ID NO: 11196 - DNA, 15 bp, Artificial Sequence
  Oligonucleotide probe
  misc_binding (1)..(15): Hybridization probe for the specific detection of wild-type HIV-1 at codon 10 of the protease gene.
cgacccttagtcaca

SEQ ID NO: 11197 - DNA, 15 bp, Artificial Sequence
  Oligonucleotide probe
  misc_binding (1)..(15): Hybridization probe for the specific detection of wild-type HIV-1 at codon 11 of the protease gene.
cccctcgtyacaata

SEQ ID NO: 11198 - DNA, 15 bp, Artificial Sequence
  Oligonucleotide probe
  misc_binding (1)..(15): Hybridization probe for the specific detection of wild-type HIV-1 at codon 20 of the protease gene.
caactaaargaagct

SEQ ID NO: 11199 - DNA, 15 bp, Artificial Sequence
  Oligonucleotide probe
  misc_binding (1)..(15): Hybridization probe for the specific detection of wild-type HIV-1 at codon 23 of the protease gene.
  misc_feature (7)..(7): n is a, c, g, or t
atctaanagagcttc

SEQ ID NO: 11200 - DNA, 15 bp, Artificial Sequence
  Oligonucleotide probe
  misc_binding (1)..(15): Hybridization probe for the specific detection of wild-type HIV-1 at codon 23 of the protease gene.
atctaayaaagcttc

SEQ ID NO: 11201 - DNA, 15 bp, Artificial Sequence
  Oligonucleotide probe
  misc_binding (1)..(15): Hybridization probe for the specific detection of wild-type HIV-1 at codon 24 of the protease gene.
tgtatcyartagagc

SEQ ID NO: 11202 - DNA, 15 bp, Artificial Sequence
  Oligonucleotide probe
  misc_binding (1)..(15): Hybridization probe for the specific detection of wild-type HIV-1 at codon 30 of the protease gene.
tactgtrtcatctgc

SEQ ID NO: 11203 - DNA, 15 bp, Artificial Sequence
  Oligonucleotide probe
  misc_binding (1)..(15): Hybridization probe for the specific detection of wild-type HIV-1 at codon 32 of the protease gene.
ttctaayactgtatc

SEQ ID NO: 11204 - DNA, 15 bp, Artificial Sequence
  Oligonucleotide probe
  misc_binding (1)..(15): Hybridization probe for the specific detection of wild-type HIV-1 at codon 33 of the protease gene.
  misc_feature (9)..(9): n is a, c, g, or t
acagtactngaagaa

SEQ ID NO: 11205 - DNA, 15 bp, Artificial Sequence
  Oligonucleotide probe
  misc_binding (1)..(15): Hybridization probe for the specific detection of wild-type HIV-1 at codon 33 of the protease gene.
acagtattygaagaa

SEQ ID NO: 11206 - DNA, 15 bp, Artificial Sequence
  Oligonucleotide probe
  misc_binding (1)..(15): Hybridization probe for the specific detection of wild-type HIV-1 at codon 43 of the protease gene.
aaatggaarccaaaa

SEQ ID NO: 11207 - DNA, 15 bp, Artificial Sequence
  Oligonucleotide probe
  misc_binding (1)..(15): Hybridization probe for the specific detection of wild-type HIV-1 at codon 46 of the protease gene.
ccaaaaatgataggg

SEQ ID NO: 11208 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (5)..(5): base is a locked nucleic acid
ccaaraatgataggrggaat

SEQ ID NO: 11209 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (9)..(9): base is a locked nucleic acid
ccaaraatgataggrggaat

SEQ ID NO: 11210 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (3)..(3): base is a locked nucleic acid
ccaaraatgataggrggaat

SEQ ID NO: 11211 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (8)..(8): base is a locked nucleic acid
ccaaraatgataggrggaat

SEQ ID NO: 11212 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (15)..(15): base is a locked nucleic acid
ccaaraatgataggrggaat

SEQ ID NO: 11213 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (16)..(16): base is a locked nucleic acid
ccaaraatgataggrggaat

SEQ ID NO: 11214 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (17)..(17): base is a locked nucleic acid
ccaaraatgataggrggaat

SEQ ID NO: 11215 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (13)..(13): base is a locked nucleic acid
ccaaraatgataggrggaat

SEQ ID NO: 11216 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (4)..(4): base is a locked nucleic acid
  modified_base (9)..(9): base is a locked nucleic acid
  modified_base (11)..(11): base is a locked nucleic acid
ccaaraatgataggrggaat

SEQ ID NO: 11217 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (3)..(3): base is a locked nucleic acid
  modified_base (9)..(9): base is a locked nucleic acid
  modified_base (11)..(11): base is a locked nucleic acid
ccaaraatgataggrggaat

SEQ ID NO: 11218 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (2)..(2): base is a locked nucleic acid
  modified_base (9)..(9): base is a locked nucleic acid
  modified_base (11)..(11): base is a locked nucleic acid
ccaaraatgataggrggaat

SEQ ID NO: 11219 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (8)..(8): base is a locked nucleic acid
  modified_base (9)..(9): base is a locked nucleic acid
  modified_base (11)..(11): base is a locked nucleic acid
ccaaraatgataggrggaat

SEQ ID NO: 11220 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (13)..(13): base is a locked nucleic acid
ccaaraatgataggrggaat

SEQ ID NO: 11221 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (16)..(16): base is a locked nucleic acid
ccaaraatgataggrggaat

SEQ ID NO: 11222 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (14)..(14): base is a locked nucleic acid
ccaaraatgataggrggaat

SEQ ID NO: 11223 - DNA, 20 bp, Artificial Sequence
  Oligonucleotide probe
  misc_binding (1)..(20): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (18)..(18): base is a locked nucleic acid
ccaaraatgataggrggaat

SEQ ID NO: 11224 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (5)..(5): base is a locked nucleic acid
ccaaraatgataggrggaa

SEQ ID NO: 11225 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (9)..(9): base is a locked nucleic acid
ccaaraatgataggrggaa

SEQ ID NO: 11226 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (3)..(3): base is a locked nucleic acid
ccaaraatgataggrggaa

SEQ ID NO: 11227 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (8)..(8): base is a locked nucleic acid
ccaaraatgataggrggaa

SEQ ID NO: 11228 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (15)..(15): base is a locked nucleic acid
ccaaraatgataggrggaa

SEQ ID NO: 11229 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (16)..(16): base is a locked nucleic acid
ccaaraatgataggrggaa

SEQ ID NO: 11230 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (17)..(17): base is a locked nucleic acid
ccaaraatgataggrggaa

SEQ ID NO: 11231 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (13)..(13): base is a locked nucleic acid
ccaaraatgataggrggaa

SEQ ID NO: 11232 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (4)..(4): base is a locked nucleic acid
  modified_base (9)..(9): base is a locked nucleic acid
  modified_base (11)..(11): base is a locked nucleic acid
ccaaraatgataggrggaa

SEQ ID NO: 11233 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (3)..(3): base is a locked nucleic acid
  modified_base (9)..(9): base is a locked nucleic acid
  modified_base (11)..(11): base is a locked nucleic acid
ccaaraatgataggrggaa

SEQ ID NO: 11234 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (2)..(2): base is a locked nucleic acid
  modified_base (9)..(9): base is a locked nucleic acid
  modified_base (11)..(11): base is a locked nucleic acid
ccaaraatgataggrggaa

SEQ ID NO: 11235 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (8)..(8): base is a locked nucleic acid
  modified_base (9)..(9): base is a locked nucleic acid
  modified_base (11)..(11): base is a locked nucleic acid
ccaaraatgataggrggaa

SEQ ID NO: 11236 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (13)..(13): base is a locked nucleic acid
ccaaraatgataggrggaa

SEQ ID NO: 11237 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (16)..(16): base is a locked nucleic acid
ccaaraatgataggrggaa

SEQ ID NO: 11238 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (14)..(14): base is a locked nucleic acid
ccaaraatgataggrggaa

SEQ ID NO: 11239 - DNA, 19 bp, Artificial Sequence
  Oligonucleotide probe
  misc_binding (1)..(19): Hybridization probe for the specific detection of wild-type HIV-1 at codon 47 of the protease gene.
  modified_base (9)..(9): base is a locked nucleic acid
  modified_base (11)..(11): base is a locked nucleic acid
  modified_base (18)..(18): base is a locked nucleic acid
ccaaraatgataggrggaa

SEQ ID NO: 11240 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (4)..(4): base is a locked nucleic acid
caaraatgataggrgga

SEQ ID NO: 11241 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (8)..(8): base is a locked nucleic acid
caaraatgataggrgga

SEQ ID NO: 11242 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (2)..(2): base is a locked nucleic acid
caaraatgataggrgga

SEQ ID NO: 11243 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (7)..(7): base is a locked nucleic acid
caaraatgataggrgga

SEQ ID NO: 11244 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (14)..(14): base is a locked nucleic acid
caaraatgataggrgga

SEQ ID NO: 11245 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (15)..(15): base is a locked nucleic acid
caaraatgataggrgga

SEQ ID NO: 11246 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (16)..(16): base is a locked nucleic acid
caaraatgataggrgga

SEQ ID NO: 11247 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (12)..(12): base is a locked nucleic acid
caaraatgataggrgga

SEQ ID NO: 11248 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (3)..(3): base is a locked nucleic acid
  modified_base (8)..(8): base is a locked nucleic acid
  modified_base (10)..(10): base is a locked nucleic acid
caaraatgataggrgga

SEQ ID NO: 11249 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (2)..(2): base is a locked nucleic acid
  modified_base (8)..(8): base is a locked nucleic acid
  modified_base (10)..(10): base is a locked nucleic acid
caaraatgataggrgga

SEQ ID NO: 11250 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (1)..(1): base is a locked nucleic acid
  modified_base (8)..(8): base is a locked nucleic acid
  modified_base (10)..(10): base is a locked nucleic acid
caaraatgataggrgga

SEQ ID NO: 11251 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (7)..(7): base is a locked nucleic acid
  modified_base (8)..(8): base is a locked nucleic acid
  modified_base (10)..(10): base is a locked nucleic acid
caaraatgataggrgga

SEQ ID NO: 11252 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (8)..(8): base is a locked nucleic acid
  modified_base (10)..(10): base is a locked nucleic acid
  modified_base (12)..(12): base is a locked nucleic acid
caaraatgataggrgga

SEQ ID NO: 11253 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (8)..(8): base is a locked nucleic acid
  modified_base (10)..(10): base is a locked nucleic acid
  modified_base (15)..(15): base is a locked nucleic acid
caaraatgataggrgga

SEQ ID NO: 11254 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (8)..(8): base is a locked nucleic acid
  modified_base (10)..(10): base is a locked nucleic acid
  modified_base (13)..(13): base is a locked nucleic acid
caaraatgataggrgga

SEQ ID NO: 11255 - DNA, 17 bp, Artificial Sequence
  Oligonucleotide probe
  misc_binding (1)..(17): Hybridization probe for the specific detection of wild-type HIV-1 at codon 47 of the protease gene.
  modified_base (8)..(8): base is a locked nucleic acid
  modified_base (10)..(10): base is a locked nucleic acid
  modified_base (17)..(17): base is a locked nucleic acid
caaraatgataggrgga

SEQ ID NO: 11256 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (4)..(4): base is a locked nucleic acid
caaraatgataggrg

SEQ ID NO: 11257 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (8)..(8): base is a locked nucleic acid
caaraatgataggrg

SEQ ID NO: 11258 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (2)..(2): base is a locked nucleic acid
caaraatgataggrg

SEQ ID NO: 11259 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (7)..(7): base is a locked nucleic acid
caaraatgataggrg

SEQ ID NO: 11260 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (14)..(14): base is a locked nucleic acid
caaraatgataggrg

SEQ ID NO: 11261 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (15)..(15): base is a locked nucleic acid
caaraatgataggrg

SEQ ID NO: 11262 - DNA, 15 bp, Artificial Sequence
  Oligonucleotide probe
  misc_binding (1)..(15): Hybridization probe for the specific detection of wild-type HIV-1 at codon 47 of the protease gene.
caaraatgataggrg

SEQ ID NO: 11263 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (12)..(12): base is a locked nucleic acid
caaraatgataggrg

SEQ ID NO: 11264 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (3)..(3): base is a locked nucleic acid
  modified_base (8)..(8): base is a locked nucleic acid
  modified_base (10)..(10): base is a locked nucleic acid
caaraatgataggrg

SEQ ID NO: 11265 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (2)..(2): base is a locked nucleic acid
  modified_base (8)..(8): base is a locked nucleic acid
  modified_base (10)..(10): base is a locked nucleic acid
caaraatgataggrg

SEQ ID NO: 11266 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (1)..(1): base is a locked nucleic acid
  modified_base (8)..(8): base is a locked nucleic acid
  modified_base (10)..(10): base is a locked nucleic acid
caaraatgataggrg

SEQ ID NO: 11267 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (7)..(7): base is a locked nucleic acid
  modified_base (8)..(8): base is a locked nucleic acid
  modified_base (10)..(10): base is a locked nucleic acid
caaraatgataggrg

SEQ ID NO: 11268 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (8)..(8): base is a locked nucleic acid
  modified_base (10)..(10): base is a locked nucleic acid
  modified_base (12)..(12): base is a locked nucleic acid
caaraatgataggrg

SEQ ID NO: 11269 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (8)..(8): base is a locked nucleic acid
  modified_base (10)..(10): base is a locked nucleic acid
  modified_base (15)..(15): base is a locked nucleic acid
caaraatgataggrg

SEQ ID NO: 11270 - DNA, 15 bp, Artificial Sequence
  Oligonucleotide probe
  misc_binding (1)..(15): Hybridization probe for the specific detection of wild-type HIV-1 at codon 47 of the protease gene.
  modified_base (8)..(8): base is a locked nucleic acid
  modified_base (10)..(10): base is a locked nucleic acid
  modified_base (13)..(13): base is a locked nucleic acid
caaraatgataggrg

SEQ ID NO: 11271 - DNA, 16 bp, Artificial Sequence
  Oligonucleotide probe
  misc_binding (1)..(16): Hybridization probe for the specific detection of wild-type HIV-1 at codon 47 of the protease gene.
  modified_base (8)..(8): base is a locked nucleic acid
  modified_base (10)..(10): base is a locked nucleic acid
caaraatgataggrgg

SEQ ID NO: 11272 - DNA, 15 bp, Artificial Sequence
  Oligonucleotide probe
  misc_binding (1)..(15): Hybridization probe for the specific detection of wild-type HIV-1 at codon 47 of the protease gene.
aaaatgataggggga

SEQ ID NO: 11273 - DNA, 20 bp, Artificial Sequence
  Oligonucleotide probe
  misc_binding (1)..(20): Hybridization probe for the specific detection of wild-type HIV-1 at codon 47 of the protease gene.
ccaaraatgataggrggaat

SEQ ID NO: 11274 - DNA, 19 bp, Artificial Sequence
  Oligonucleotide probe
  misc_binding (1)..(19): Hybridization probe for the specific detection of wild-type HIV-1 at codon 47 of the protease gene.
ccaaraatgataggrggaa

SEQ ID NO: 11275 - DNA, 17 bp, Artificial Sequence
  Oligonucleotide probe
  misc_binding (1)..(17): Hybridization probe for the specific detection of wild-type HIV-1 at codon 47 of the protease gene.
caaraatgataggrgga

SEQ ID NO: 11276 - DNA, 15 bp, Artificial Sequence
  Oligonucleotide probe
  misc_binding (1)..(15): Hybridization probe for the specific detection of wild-type HIV-1 at codon 47 of the protease gene.
caaraatgataggrg

SEQ ID NO: 11277 - DNA, 16 bp, Artificial Sequence
  Oligonucleotide probe
  misc_binding (1)..(16): Hybridization probe for the specific detection of wild-type HIV-1 at codon 47 of the protease gene.
caaraatgataggrgg

SEQ ID NO: 11278 - DNA, 15 bp, Artificial Sequence
  Oligonucleotide probe
  misc_binding (1)..(15): Hybridization probe for the specific detection of wild-type HIV-1 at codon 48 of the protease gene.
atgataggrggaatt

SEQ ID NO: 11279 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (7)..(7): base is a locked nucleic acid
ataggrggaattggaggytt

SEQ ID NO: 11280 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (5)..(5): base is a locked nucleic acid
ataggrggaattggaggytt

SEQ ID NO: 11281 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (8)..(8): base is a locked nucleic acid
ataggrggaattggaggytt

SEQ ID NO: 11282 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (3)..(3): base is a locked nucleic acid
ataggrggaattggaggytt

SEQ ID NO: 11283 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (13)..(13): base is a locked nucleic acid
ataggrggaattggaggytt

SEQ ID NO: 11284 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (17)..(17): base is a locked nucleic acid
ataggrggaattggaggytt

SEQ ID NO: 11285 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (11)..(11): base is a locked nucleic acid
ataggrggaattggaggytt

SEQ ID NO: 11286 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (15)..(15): base is a locked nucleic acid
ataggrggaattggaggytt

SEQ ID NO: 11287 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (7)..(7): base is a locked nucleic acid
  modified_base (9)..(9): base is a locked nucleic acid
  modified_base (11)..(11): base is a locked nucleic acid
ataggrggaattggaggytt

SEQ ID NO: 11288 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (6)..(6): base is a locked nucleic acid
  modified_base (9)..(9): base is a locked nucleic acid
  modified_base (11)..(11): base is a locked nucleic acid
ataggrggaattggaggytt

SEQ ID NO: 11289 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (2)..(2): base is a locked nucleic acid
  modified_base (9)..(9): base is a locked nucleic acid
  modified_base (11)..(11): base is a locked nucleic acid
ataggrggaattggaggytt

SEQ ID NO: 11290 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (3)..(3): base is a locked nucleic acid
  modified_base (9)..(9): base is a locked nucleic acid
  modified_base (11)..(11): base is a locked nucleic acid
ataggrggaattggaggytt

SEQ ID NO: 11291 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (18)..(18): base is a locked nucleic acid
ataggrggaattggaggytt

SEQ ID NO: 11292 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (17)..(17): base is a locked nucleic acid
ataggrggaattggaggytt

SEQ ID NO: 11293 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (14)..(14): base is a locked nucleic acid
ataggrggaattggaggytt

SEQ ID NO: 11294 - DNA, 20 bp, Artificial Sequence
  Oligonucleotide probe
  misc_binding (1)..(20): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (16)..(16): base is a locked nucleic acid
ataggrggaattggaggytt

SEQ ID NO: 11295 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (7)..(7): base is a locked nucleic acid
ataggrggaattggaggyt

SEQ ID NO: 11296 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (5)..(5): base is a locked nucleic acid
ataggrggaattggaggyt

SEQ ID NO: 11297 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (8)..(8): base is a locked nucleic acid
ataggrggaattggaggyt

SEQ ID NO: 11298 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (3)..(3): base is a locked nucleic acid
ataggrggaattggaggyt

SEQ ID NO: 11299 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (13)..(13): base is a locked nucleic acid
ataggrggaattggaggyt

SEQ ID NO: 11300 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (17)..(17): base is a locked nucleic acid
ataggrggaattggaggyt

SEQ ID NO: 11301 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (11)..(11): base is a locked nucleic acid
ataggrggaattggaggyt

SEQ ID NO: 11302 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (15)..(15): base is a locked nucleic acid
ataggrggaattggaggyt

SEQ ID NO: 11303 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (7)..(7): base is a locked nucleic acid
  modified_base (9)..(9): base is a locked nucleic acid
  modified_base (11)..(11): base is a locked nucleic acid
ataggrggaattggaggyt

SEQ ID NO: 11304 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (6)..(6): base is a locked nucleic acid
  modified_base (9)..(9): base is a locked nucleic acid
  modified_base (11)..(11): base is a locked nucleic acid
ataggrggaattggaggyt

SEQ ID NO: 11305 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (2)..(2): base is a locked nucleic acid
  modified_base (9)..(9): base is a locked nucleic acid
  modified_base (11)..(11): base is a locked nucleic acid
ataggrggaattggaggyt

SEQ ID NO: 11306 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (3)..(3): base is a locked nucleic acid
  modified_base (9)..(9): base is a locked nucleic acid
  modified_base (11)..(11): base is a locked nucleic acid
ataggrggaattggaggyt

SEQ ID NO: 11307 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (18)..(18): base is a locked nucleic acid
ataggrggaattggaggyt

SEQ ID NO: 11308 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (17)..(17): base is a locked nucleic acid
ataggrggaattggaggyt

SEQ ID NO: 11309 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (14)..(14): base is a locked nucleic acid
ataggrggaattggaggyt

SEQ ID NO: 11310 - DNA, 19 bp, Artificial Sequence
  Oligonucleotide probe
  misc_binding (1)..(19): Hybridization probe for the specific detection of wild-type HIV-1 at codon 50 of the protease gene.
  modified_base (9)..(9): base is a locked nucleic acid
  modified_base (11)..(11): base is a locked nucleic acid
  modified_base (16)..(16): base is a locked nucleic acid
ataggrggaattggaggyt

SEQ ID NO: 11311 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (6)..(6): base is a locked nucleic acid
taggrggaattggaggy

SEQ ID NO: 11312 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (4)..(4): base is a locked nucleic acid
taggrggaattggaggy

SEQ ID NO: 11313 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (7)..(7): base is a locked nucleic acid
taggrggaattggaggy

SEQ ID NO: 11314 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (2)..(2): base is a locked nucleic acid
taggrggaattggaggy

SEQ ID NO: 11315 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (12)..(12): base is a locked nucleic acid
taggrggaattggaggy

SEQ ID NO: 11316 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (16)..(16): base is a locked nucleic acid
taggrggaattggaggy

SEQ ID NO: 11317 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (10)..(10): base is a locked nucleic acid
taggrggaattggaggy

SEQ ID NO: 11318 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (14)..(14): base is a locked nucleic acid
taggrggaattggaggy

SEQ ID NO: 11319 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (6)..(6): base is a locked nucleic acid
  modified_base (8)..(8): base is a locked nucleic acid
  modified_base (10)..(10): base is a locked nucleic acid
taggrggaattggaggy

SEQ ID NO: 11320 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (5)..(5): base is a locked nucleic acid
  modified_base (8)..(8): base is a locked nucleic acid
  modified_base (10)..(10): base is a locked nucleic acid
taggrggaattggaggy

SEQ ID NO: 11321 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (1)..(1): base is a locked nucleic acid
  modified_base (8)..(8): base is a locked nucleic acid
  modified_base (10)..(10): base is a locked nucleic acid
taggrggaattggaggy

SEQ ID NO: 11322 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (2)..(2): base is a locked nucleic acid
  modified_base (8)..(8): base is a locked nucleic acid
  modified_base (10)..(10): base is a locked nucleic acid
taggrggaattggaggy

SEQ ID NO: 11323 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (8)..(8): base is a locked nucleic acid
  modified_base (10)..(10): base is a locked nucleic acid
  modified_base (17)..(17): base is a locked nucleic acid
taggrggaattggaggy

SEQ ID NO: 11324 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (8)..(8): base is a locked nucleic acid
  modified_base (10)..(10): base is a locked nucleic acid
  modified_base (16)..(16): base is a locked nucleic acid
taggrggaattggaggy

SEQ ID NO: 11325 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (8)..(8): base is a locked nucleic acid
  modified_base (10)..(10): base is a locked nucleic acid
  modified_base (13)..(13): base is a locked nucleic acid
taggrggaattggaggy

SEQ ID NO: 11326 - DNA, 17 bp, Artificial Sequence
  Oligonucleotide probe
  misc_binding (1)..(17): Hybridization probe for the specific detection of wild-type HIV-1 at codon 50 of the protease gene.
  modified_base (8)..(8): base is a locked nucleic acid
  modified_base (10)..(10): base is a locked nucleic acid
  modified_base (15)..(15): base is a locked nucleic acid
taggrggaattggaggy

SEQ ID NO: 11327 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (6)..(6): base is a locked nucleic acid
taggrggaattggag

SEQ ID NO: 11328 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (4)..(4): base is a locked nucleic acid
taggrggaattggag

SEQ ID NO: 11329 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (7)..(7): base is a locked nucleic acid
taggrggaattggag

SEQ ID NO: 11330 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (2)..(2): base is a locked nucleic acid
taggrggaattggag

SEQ ID NO: 11331 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (12)..(12): base is a locked nucleic acid
taggrggaattggag

SEQ ID NO: 11332 - DNA, 15 bp, Artificial Sequence
  Oligonucleotide probe
  misc_binding (1)..(15): Hybridization probe for the specific detection of wild-type HIV-1 at codon 50 of the protease gene.
taggrggaattggag

SEQ ID NO: 11333 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (10)..(10): base is a locked nucleic acid
taggrggaattggag

SEQ ID NO: 11334 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (14)..(14): base is a locked nucleic acid
taggrggaattggag

SEQ ID NO: 11335 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (6)..(6): base is a locked nucleic acid
  modified_base (8)..(8): base is a locked nucleic acid
  modified_base (10)..(10): base is a locked nucleic acid
taggrggaattggag

SEQ ID NO: 11336 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (5)..(5): base is a locked nucleic acid
  modified_base (8)..(8): base is a locked nucleic acid
  modified_base (10)..(10): base is a locked nucleic acid
taggrggaattggag

SEQ ID NO: 11337 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (1)..(1): base is a locked nucleic acid
  modified_base (8)..(8): base is a locked nucleic acid
  modified_base (10)..(10): base is a locked nucleic acid
taggrggaattggag

SEQ ID NO: 11338 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (2)..(2): base is a locked nucleic acid
  modified_base (8)..(8): base is a locked nucleic acid
  modified_base (10)..(10): base is a locked nucleic acid
taggrggaattggag

SEQ ID NO: 11339 - DNA, 16 bp, Artificial Sequence
  Oligonucleotide probe
  misc_binding (1)..(16): Hybridization probe for the specific detection of wild-type HIV-1 at codon 50 of the protease gene.
  modified_base (8)..(8): base is a locked nucleic acid
  modified_base (10)..(10): base is a locked nucleic acid
taggrggaattggagg

SEQ ID NO: 11340 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (8)..(8): base is a locked nucleic acid
  modified_base (10)..(10): base is a locked nucleic acid
taggrggaattggag

SEQ ID NO: 11341 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (8)..(8): base is a locked nucleic acid
  modified_base (10)..(10): base is a locked nucleic acid
  modified_base (13)..(13): base is a locked nucleic acid
taggrggaattggag

SEQ ID NO: 11342 - DNA, 15 bp, Artificial Sequence
  Oligonucleotide probe
  misc_binding (1)..(15): Hybridization probe for the specific detection of wild-type HIV-1 at codon 50 of the protease gene.
  modified_base (8)..(8): base is a locked nucleic acid
  modified_base (10)..(10): base is a locked nucleic acid
  modified_base (15)..(15): base is a locked nucleic acid
taggrggaattggag

SEQ ID NO: 11343 - DNA, 15 bp, Artificial Sequence
  Oligonucleotide probe
  misc_binding (1)..(15): Hybridization probe for the specific detection of wild-type HIV-1 at codon 50 of the protease gene.
acctccaattccccc

SEQ ID NO: 11344 - DNA, 20 bp, Artificial Sequence
  Oligonucleotide probe
  misc_binding (1)..(20): Hybridization probe for the specific detection of wild-type HIV-1 at codon 50 of the protease gene.
ataggrggaattggaggytt

SEQ ID NO: 11345 - DNA, 19 bp, Artificial Sequence
  Oligonucleotide probe
  misc_binding (1)..(19): Hybridization probe for the specific detection of wild-type HIV-1 at codon 50 of the protease gene.
ataggrggaattggaggyt

SEQ ID NO: 11346 - DNA, 17 bp, Artificial Sequence
  Oligonucleotide probe
  misc_binding (1)..(17): Hybridization probe for the specific detection of wild-type HIV-1 at codon 50 of the protease gene.
taggrggaattggaggy

SEQ ID NO: 11347 - DNA, 15 bp, Artificial Sequence
  Oligonucleotide probe
  misc_binding (1)..(15): Hybridization probe for the specific detection of wild-type HIV-1 at codon 50 of the protease gene.
taggrggaattggag

SEQ ID NO: 11348 - DNA, 16 bp, Artificial Sequence
  Oligonucleotide probe
  misc_binding (1)..(16): Hybridization probe for the specific detection of wild-type HIV-1 at codon 50 of the protease gene.
taggrggaattggagg

SEQ ID NO: 11349 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (8)..(8): base is a locked nucleic acid
tggaggyttyatyaargtaa

SEQ ID NO: 11350 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (2)..(2): base is a locked nucleic acid
tggaggyttyatyaargtaa

SEQ ID NO: 11351 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (7)..(7): base is a locked nucleic acid
tggaggyttyatyaargtaa

SEQ ID NO: 11352 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (3)..(3): base is a locked nucleic acid
tggaggyttyatyaargtaa

SEQ ID NO: 11353 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (15)..(15): base is a locked nucleic acid
tggaggyttyatyaargtaa

SEQ ID NO: 11354 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (17)..(17): base is a locked nucleic acid
tggaggyttyatyaargtaa

SEQ ID NO: 11355 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (11)..(11): base is a locked nucleic acid
tggaggyttyatyaargtaa

SEQ ID NO: 11356 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (14)..(14): base is a locked nucleic acid
tggaggyttyatyaargtaa

SEQ ID NO: 11357 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (5)..(5): base is a locked nucleic acid
  modified_base (9)..(9): base is a locked nucleic acid
  modified_base (11)..(11): base is a locked nucleic acid
tggaggyttyatyaargtaa

SEQ ID NO: 11358 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (3)..(3): base is a locked nucleic acid
  modified_base (9)..(9): base is a locked nucleic acid
  modified_base (11)..(11): base is a locked nucleic acid
tggaggyttyatyaargtaa

SEQ ID NO: 11359 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (8)..(8): base is a locked nucleic acid
  modified_base (9)..(9): base is a locked nucleic acid
  modified_base (11)..(11): base is a locked nucleic acid
tggaggyttyatyaargtaa

SEQ ID NO: 11360 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (4)..(4): base is a locked nucleic acid
  modified_base (9)..(9): base is a locked nucleic acid
  modified_base (11)..(11): base is a locked nucleic acid
tggaggyttyatyaargtaa

SEQ ID NO: 11361 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (14)..(14): base is a locked nucleic acid
tggaggyttyatyaargtaa

SEQ ID NO: 11362 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (13)..(13): base is a locked nucleic acid
tggaggyttyatyaargtaa

SEQ ID NO: 11363 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (16)..(16): base is a locked nucleic acid
tggaggyttyatyaargtaa

SEQ ID NO: 11364 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (17)..(17): base is a locked nucleic acid
tggaggyttyatyaargtaa

SEQ ID NO: 11365 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (6)..(6): base is a locked nucleic acid
ttggaggytttatyaargta

SEQ ID NO: 11366 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (8)..(8): base is a locked nucleic acid
ttggaggytttatyaargta

SEQ ID NO: 11367 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (7)..(7): base is a locked nucleic acid
ttggaggytttatyaargta

SEQ ID NO: 11368 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (3)..(3): base is a locked nucleic acid
ttggaggytttatyaargta

SEQ ID NO: 11369 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (17)..(17): base is a locked nucleic acid
ttggaggytttatyaargta

SEQ ID NO: 11370 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (18)..(18): base is a locked nucleic acid
ttggaggytttatyaargta

SEQ ID NO: 11371 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (12)..(12): base is a locked nucleic acid
ttggaggytttatyaargta

SEQ ID NO: 11372 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (14)..(14): base is a locked nucleic acid
ttggaggytttatyaargta

SEQ ID NO: 11373 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (2)..(2): base is a locked nucleic acid
  modified_base (9)..(9): base is a locked nucleic acid
  modified_base (11)..(11): base is a locked nucleic acid
ttggaggytttatyaargta

SEQ ID NO: 11374 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (7)..(7): base is a locked nucleic acid
  modified_base (9)..(9): base is a locked nucleic acid
  modified_base (11)..(11): base is a locked nucleic acid
ttggaggytttatyaargta

SEQ ID NO: 11375 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (5)..(5): base is a locked nucleic acid
  modified_base (9)..(9): base is a locked nucleic acid
  modified_base (11)..(11): base is a locked nucleic acid
ttggaggytttatyaargta

SEQ ID NO: 11376 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (8)..(8): base is a locked nucleic acid
  modified_base (9)..(9): base is a locked nucleic acid
  modified_base (11)..(11): base is a locked nucleic acid
ttggaggytttatyaargta

SEQ ID NO: 11377 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (16)..(16): base is a locked nucleic acid
ttggaggytttatyaargta

SEQ ID NO: 11378 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (12)..(12): base is a locked nucleic acid
ttggaggytttatyaargta

SEQ ID NO: 11379 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (18)..(18): base is a locked nucleic acid
ttggaggytttatyaargta

SEQ ID NO: 11380 - DNA, 20 bp, Artificial Sequence
  Oligonucleotide probe
  misc_binding (1)..(20): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (15)..(15): base is a locked nucleic acid
ttggaggytttatyaargta

SEQ ID NO: 11381 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (8)..(8): base is a locked nucleic acid
tggaggyttyatyaargta

SEQ ID NO: 11382 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (2)..(2): base is a locked nucleic acid
tggaggyttyatyaargta

SEQ ID NO: 11383 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (7)..(7): base is a locked nucleic acid
tggaggyttyatyaargta

SEQ ID NO: 11384 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (3)..(3): base is a locked nucleic acid
tggaggyttyatyaargta

SEQ ID NO: 11385 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (15)..(15): base is a locked nucleic acid
tggaggyttyatyaargta

SEQ ID NO: 11386 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (17)..(17): base is a locked nucleic acid
tggaggyttyatyaargta

SEQ ID NO: 11387 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (11)..(11): base is a locked nucleic acid
tggaggyttyatyaargta

SEQ ID NO: 11388 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (14)..(14): base is a locked nucleic acid
tggaggyttyatyaargta

SEQ ID NO: 11389 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (5)..(5): base is a locked nucleic acid
  modified_base (9)..(9): base is a locked nucleic acid
  modified_base (11)..(11): base is a locked nucleic acid
tggaggyttyatyaargta

SEQ ID NO: 11390 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (3)..(3): base is a locked nucleic acid
  modified_base (9)..(9): base is a locked nucleic acid
  modified_base (11)..(11): base is a locked nucleic acid
tggaggyttyatyaargta

SEQ ID NO: 11391 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (8)..(8): base is a locked nucleic acid
  modified_base (9)..(9): base is a locked nucleic acid
  modified_base (11)..(11): base is a locked nucleic acid
tggaggyttyatyaargta

SEQ ID NO: 11392 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (4)..(4): base is a locked nucleic acid
  modified_base (9)..(9): base is a locked nucleic acid
  modified_base (11)..(11): base is a locked nucleic acid
tggaggyttyatyaargta

SEQ ID NO: 11393 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (14)..(14): base is a locked nucleic acid
tggaggyttyatyaargta

SEQ ID NO: 11394 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (13)..(13): base is a locked nucleic acid
tggaggyttyatyaargta

SEQ ID NO: 11395 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (16)..(16): base is a locked nucleic acid
tggaggyttyatyaargta

SEQ ID NO: 11396 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (17)..(17): base is a locked nucleic acid
tggaggyttyatyaargta

SEQ ID NO: 11397 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (6)..(6): base is a locked nucleic acid
ttggaggytttatyaargt

SEQ ID NO: 11398 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (8)..(8): base is a locked nucleic acid
ttggaggytttatyaargt

SEQ ID NO: 11399 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (7)..(7): base is a locked nucleic acid
ttggaggytttatyaargt

SEQ ID NO: 11400 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (3)..(3): base is a locked nucleic acid
ttggaggytttatyaargt

SEQ ID NO: 11401 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (17)..(17): base is a locked nucleic acid
ttggaggytttatyaargt

SEQ ID NO: 11402 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (18)..(18): base is a locked nucleic acid
ttggaggytttatyaargt

SEQ ID NO: 11403 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (12)..(12): base is a locked nucleic acid
ttggaggytttatyaargt

SEQ ID NO: 11404 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (14)..(14): base is a locked nucleic acid
ttggaggytttatyaargt

SEQ ID NO: 11405 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (2)..(2): base is a locked nucleic acid
  modified_base (9)..(9): base is a locked nucleic acid
  modified_base (11)..(11): base is a locked nucleic acid
ttggaggytttatyaargt

SEQ ID NO: 11406 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (7)..(7): base is a locked nucleic acid
  modified_base (9)..(9): base is a locked nucleic acid
  modified_base (11)..(11): base is a locked nucleic acid
ttggaggytttatyaargt

SEQ ID NO: 11407 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (5)..(5): base is a locked nucleic acid
  modified_base (9)..(9): base is a locked nucleic acid
  modified_base (11)..(11): base is a locked nucleic acid
ttggaggytttatyaargt

SEQ ID NO: 11408 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (8)..(8): base is a locked nucleic acid
  modified_base (9)..(9): base is a locked nucleic acid
  modified_base (11)..(11): base is a locked nucleic acid
ttggaggytttatyaargt

SEQ ID NO: 11409 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (16)..(16): base is a locked nucleic acid
ttggaggytttatyaargt

SEQ ID NO: 11410 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (12)..(12): base is a locked nucleic acid
ttggaggytttatyaargt

SEQ ID NO: 11411 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (18)..(18): base is a locked nucleic acid
ttggaggytttatyaargt

SEQ ID NO: 11412 - DNA, 19 bp, Artificial Sequence
  Oligonucleotide probe
  misc_binding (1)..(19): Hybridization probe for the specific detection of wild-type HIV-1 at codon 53 of the protease gene.
  modified_base (9)..(9): base is a locked nucleic acid
  modified_base (11)..(11): base is a locked nucleic acid
  modified_base (15)..(15): base is a locked nucleic acid
ttggaggytttatyaargt

SEQ ID NO: 11413 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (7)..(7): base is a locked nucleic acid
ggaggyttyatyaargt

SEQ ID NO: 11414 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (1)..(1): base is a locked nucleic acid
ggaggyttyatyaargt

SEQ ID NO: 11415 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (6)..(6): base is a locked nucleic acid
ggaggyttyatyaargt

SEQ ID NO: 11416 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (2)..(2): base is a locked nucleic acid
ggaggyttyatyaargt

SEQ ID NO: 11417 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (14)..(14): base is a locked nucleic acid
ggaggyttyatyaargt

SEQ ID NO: 11418 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (16)..(16): base is a locked nucleic acid
ggaggyttyatyaargt

SEQ ID NO: 11419 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (10)..(10): base is a locked nucleic acid
ggaggyttyatyaargt

SEQ ID NO: 11420 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (13)..(13): base is a locked nucleic acid
ggaggyttyatyaargt

SEQ ID NO: 11421 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (4)..(4): base is a locked nucleic acid
  modified_base (8)..(8): base is a locked nucleic acid
  modified_base (10)..(10): base is a locked nucleic acid
ggaggyttyatyaargt

SEQ ID NO: 11422 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (2)..(2): base is a locked nucleic acid
  modified_base (8)..(8): base is a locked nucleic acid
  modified_base (10)..(10): base is a locked nucleic acid
ggaggyttyatyaargt

SEQ ID NO: 11423 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (7)..(7): base is a locked nucleic acid
  modified_base (8)..(8): base is a locked nucleic acid
  modified_base (10)..(10): base is a locked nucleic acid
ggaggyttyatyaargt

SEQ ID NO: 11424 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (3)..(3): base is a locked nucleic acid
  modified_base (8)..(8): base is a locked nucleic acid
  modified_base (10)..(10): base is a locked nucleic acid
ggaggyttyatyaargt

SEQ ID NO: 11425 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (13)..(13): base is a locked nucleic acid
ggaggyttyatyaargt

SEQ ID NO: 11426 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (12)..(12): base is a locked nucleic acid
ggaggyttyatyaargt

SEQ ID NO: 11427 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (15)..(15): base is a locked nucleic acid
ggaggyttyatyaargt

SEQ ID NO: 11428 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (16)..(16): base is a locked nucleic acid
ggaggyttyatyaargt

SEQ ID NO: 11429 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (5)..(5): base is a locked nucleic acid
tggaggytttatyaarg

SEQ ID NO: 11430 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (7)..(7): base is a locked nucleic acid
tggaggytttatyaarg

SEQ ID NO: 11431 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (6)..(6): base is a locked nucleic acid
tggaggytttatyaarg

SEQ ID NO: 11432 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (2)..(2): base is a locked nucleic acid
tggaggytttatyaarg

SEQ ID NO: 11433 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (16)..(16): base is a locked nucleic acid
tggaggytttatyaarg

SEQ ID NO: 11434 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (17)..(17): base is a locked nucleic acid
tggaggytttatyaarg

SEQ ID NO: 11435 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (11)..(11): base is a locked nucleic acid
tggaggytttatyaarg

SEQ ID NO: 11436 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (13)..(13): base is a locked nucleic acid
tggaggytttatyaarg

SEQ ID NO: 11437 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (1)..(1): base is a locked nucleic acid
  modified_base (8)..(8): base is a locked nucleic acid
  modified_base (10)..(10): base is a locked nucleic acid
tggaggytttatyaarg

SEQ ID NO: 11438 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (6)..(6): base is a locked nucleic acid
  modified_base (8)..(8): base is a locked nucleic acid
  modified_base (10)..(10): base is a locked nucleic acid
tggaggytttatyaarg

SEQ ID NO: 11439 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (4)..(4): base is a locked nucleic acid
  modified_base (8)..(8): base is a locked nucleic acid
  modified_base (10)..(10): base is a locked nucleic acid
tggaggytttatyaarg

SEQ ID NO: 11440 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (7)..(7): base is a locked nucleic acid
  modified_base (8)..(8): base is a locked nucleic acid
  modified_base (10)..(10): base is a locked nucleic acid
tggaggytttatyaarg

SEQ ID NO: 11441 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (15)..(15): base is a locked nucleic acid
tggaggytttatyaarg

SEQ ID NO: 11442 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (11)..(11): base is a locked nucleic acid
tggaggytttatyaarg

SEQ ID NO: 11443 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (17)..(17): base is a locked nucleic acid
tggaggytttatyaarg

SEQ ID NO: 11444 - DNA, 17 bp, Artificial Sequence
  Oligonucleotide probe
  misc_binding (1)..(17): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (14)..(14): base is a locked nucleic acid
tggaggytttatyaarg

SEQ ID NO: 11445 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (7)..(7): base is a locked nucleic acid
ggaggyttyatyaar

SEQ ID NO: 11446 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (1)..(1): base is a locked nucleic acid
ggaggyttyatyaar

SEQ ID NO: 11447 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (6)..(6): base is a locked nucleic acid
ggaggyttyatyaar

SEQ ID NO: 11448 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (2)..(2): base is a locked nucleic acid
ggaggyttyatyaar

SEQ ID NO: 11449 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (14)..(14): base is a locked nucleic acid
ggaggyttyatyaar

SEQ ID NO: 11450 - DNA, 15 bp, Artificial Sequence
  Oligonucleotide probe
  misc_binding (1)..(15): Hybridization probe for the specific detection of wild-type HIV-1 at codon 53 of the protease gene.
ggaggyttyatyaar

SEQ ID NO: 11451 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (10)..(10): base is a locked nucleic acid
ggaggyttyatyaar

SEQ ID NO: 11452 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (13)..(13): base is a locked nucleic acid
ggaggyttyatyaar

SEQ ID NO: 11453 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (4)..(4): base is a locked nucleic acid
  modified_base (8)..(8): base is a locked nucleic acid
  modified_base (10)..(10): base is a locked nucleic acid
ggaggyttyatyaar

SEQ ID NO: 11454 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (2)..(2): base is a locked nucleic acid
  modified_base (8)..(8): base is a locked nucleic acid
  modified_base (10)..(10): base is a locked nucleic acid
ggaggyttyatyaar

SEQ ID NO: 11455 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (7)..(7): base is a locked nucleic acid
  modified_base (8)..(8): base is a locked nucleic acid
  modified_base (10)..(10): base is a locked nucleic acid
ggaggyttyatyaar

SEQ ID NO: 11456 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (3)..(3): base is a locked nucleic acid
  modified_base (8)..(8): base is a locked nucleic acid
  modified_base (10)..(10): base is a locked nucleic acid
ggaggyttyatyaar

SEQ ID NO: 11457 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (13)..(13): base is a locked nucleic acid
ggaggyttyatyaar

SEQ ID NO: 11458 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (12)..(12): base is a locked nucleic acid
ggaggyttyatyaar

SEQ ID NO: 11459 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (15)..(15): base is a locked nucleic acid
ggaggyttyatyaar

SEQ ID NO: 11460 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (8)..(8): base is a locked nucleic acid
  modified_base (10)..(10): base is a locked nucleic acid
ggaggyttyatyaar

SEQ ID NO: 11461 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (5)..(5): base is a locked nucleic acid
tggaggytttatyaa

SEQ ID NO: 11462 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (7)..(7): base is a locked nucleic acid
tggaggytttatyaa

SEQ ID NO: 11463 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (6)..(6): base is a locked nucleic acid
tggaggytttatyaa

SEQ ID NO: 11464 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (2)..(2): base is a locked nucleic acid
tggaggytttatyaa

SEQ ID NO: 11465 - DNA, 15 bp, Artificial Sequence
  Oligonucleotide probe
  misc_binding (1)..(15): Hybridization probe for the specific detection of wild-type HIV-1 at codon 53 of the protease gene.
tggaggytttatyaa

SEQ ID NO: 11466 - DNA, 16 bp, Artificial Sequence
  Oligonucleotide probe
  misc_binding (1)..(16): Hybridization probe for the specific detection of wild-type HIV-1 at codon 53 of the protease gene.
tggaggytttatyaar

SEQ ID NO: 11467 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (11)..(11): base is a locked nucleic acid
tggaggytttatyaa

SEQ ID NO: 11468 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (13)..(13): base is a locked nucleic acid
tggaggytttatyaa

SEQ ID NO: 11469 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (1)..(1): base is a locked nucleic acid
  modified_base (8)..(8): base is a locked nucleic acid
  modified_base (10)..(10): base is a locked nucleic acid
tggaggytttatyaa

SEQ ID NO: 11470 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (6)..(6): base is a locked nucleic acid
  modified_base (8)..(8): base is a locked nucleic acid
  modified_base (10)..(10): base is a locked nucleic acid
tggaggytttatyaa

SEQ ID NO: 11471 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (4)..(4): base is a locked nucleic acid
  modified_base (8)..(8): base is a locked nucleic acid
  modified_base (10)..(10): base is a locked nucleic acid
tggaggytttatyaa

SEQ ID NO: 11472 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (7)..(7): base is a locked nucleic acid
  modified_base (8)..(8): base is a locked nucleic acid
  modified_base (10)..(10): base is a locked nucleic acid
tggaggytttatyaa

SEQ ID NO: 11473 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (15)..(15): base is a locked nucleic acid
tggaggytttatyaa

SEQ ID NO: 11474 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (11)..(11): base is a locked nucleic acid
tggaggytttatyaa

SEQ ID NO: 11475 - DNA, 16 bp, Artificial Sequence
  Oligonucleotide probe
  misc_binding (1)..(16): Hybridization probe for the specific detection of wild-type HIV-1 at codon 53 of the protease gene.
  modified_base (8)..(8): base is a locked nucleic acid
  modified_base (10)..(10): base is a locked nucleic acid
tggaggytttatyaar

SEQ ID NO: 11476 - DNA, 15 bp, Artificial Sequence
  Oligonucleotide probe
  misc_binding (1)..(15): Hybridization probe for the specific detection of wild-type HIV-1 at codon 53 of the protease gene.
  modified_base (8)..(8): base is a locked nucleic acid
  modified_base (10)..(10): base is a locked nucleic acid
  modified_base (14)..(14): base is a locked nucleic acid
tggaggytttatyaa

SEQ ID NO: 11477 - DNA, 15 bp, Artificial Sequence
  Oligonucleotide probe
  misc_binding (1)..(15): Hybridization probe for the specific detection of wild-type HIV-1 at codon 53 of the protease gene.
tttgatraaacctcc

SEQ ID NO: 11478 - DNA, 20 bp, Artificial Sequence
  Oligonucleotide probe
  misc_binding (1)..(20): Hybridization probe for the specific detection of wild-type HIV-1 at codon 53 of the protease gene.
tggaggyttyatyaargtaa

SEQ ID NO: 11479 - DNA, 20 bp, Artificial Sequence
  Oligonucleotide probe
  misc_binding (1)..(20): Hybridization probe for the specific detection of wild-type HIV-1 at codon 53 of the protease gene.
ttggaggytttatyaargta

SEQ ID NO: 11480 - DNA, 19 bp, Artificial Sequence
  Oligonucleotide probe
  misc_binding (1)..(19): Hybridization probe for the specific detection of wild-type HIV-1 at codon 53 of the protease gene.
tggaggyttyatyaargta

SEQ ID NO: 11481 - DNA, 19 bp, Artificial Sequence
  Oligonucleotide probe
  misc_binding (1)..(19): Hybridization probe for the specific detection of wild-type HIV-1 at codon 53 of the protease gene.
ttggaggytttatyaargt

SEQ ID NO: 11482 - DNA, 17 bp, Artificial Sequence
  Oligonucleotide probe
  misc_binding (1)..(17): Hybridization probe for the specific detection of wild-type HIV-1 at codon 53 of the protease gene.
ggaggyttyatyaargt

SEQ ID NO: 11483 - DNA, 17 bp, Artificial Sequence
  Oligonucleotide probe
  misc_binding (1)..(17): Hybridization probe for the specific detection of wild-type HIV-1 at codon 53 of the protease gene.
tggaggytttatyaarg

SEQ ID NO: 11484 - DNA, 15 bp, Artificial Sequence
  Oligonucleotide probe
  misc_binding (1)..(15): Hybridization probe for the specific detection of wild-type HIV-1 at codon 53 of the protease gene.
ggaggyttyatyaar

SEQ ID NO: 11485 - DNA, 15 bp, Artificial Sequence
  Oligonucleotide probe
  misc_binding (1)..(15): Hybridization probe for the specific detection of wild-type HIV-1 at codon 53 of the protease gene.
tggaggytttatyaa

SEQ ID NO: 11486 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (6)..(6): base is a locked nucleic acid
aggytttatyaargtaarrc

SEQ ID NO: 11487 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
aggytttatyaargtaarrc

SEQ ID NO: 11488 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (7)..(7): base is a locked nucleic acid
aggytttatyaargtaarrc

SEQ ID NO: 11489 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (8)..(8): base is a locked nucleic acid
aggytttatyaargtaarrc

SEQ ID NO: 11490 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (11)..(11): base is a locked nucleic acid
aggytttatyaargtaarrc

SEQ ID NO: 11491 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (15)..(15): base is a locked nucleic acid
aggytttatyaargtaarrc

SEQ ID NO: 11492 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (17)..(17): base is a locked nucleic acid
aggytttatyaargtaarrc

SEQ ID NO: 11493 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (13)..(13): base is a locked nucleic acid
aggytttatyaargtaarrc

SEQ ID NO: 11494 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (6)..(6): base is a locked nucleic acid
  modified_base (9)..(9): base is a locked nucleic acid
  modified_base (11)..(11): base is a locked nucleic acid
aggytttatyaargtaarrc

SEQ ID NO: 11495 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (5)..(5): base is a locked nucleic acid
  modified_base (9)..(9): base is a locked nucleic acid
  modified_base (11)..(11): base is a locked nucleic acid
aggytttatyaargtaarrc

SEQ ID NO: 11496 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (4)..(4): base is a locked nucleic acid
  modified_base (9)..(9): base is a locked nucleic acid
  modified_base (11)..(11): base is a locked nucleic acid
aggytttatyaargtaarrc

SEQ ID NO: 11497 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (3)..(3): base is a locked nucleic acid
  modified_base (9)..(9): base is a locked nucleic acid
  modified_base (11)..(11): base is a locked nucleic acid
aggytttatyaargtaarrc

SEQ ID NO: 11498 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (14)..(14): base is a locked nucleic acid
aggytttatyaargtaarrc

SEQ ID NO: 11499 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (19)..(19): base is a locked nucleic acid
aggytttatyaargtaarrc

SEQ ID NO: 11500 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (13)..(13): base is a locked nucleic acid
aggytttatyaargtaarrc

SEQ ID NO: 11501 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (12)..(12): base is a locked nucleic acid
aggytttatyaargtaarrc

SEQ ID NO: 11502 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (7)..(7): base is a locked nucleic acid
gaggytttatyaargtaarr

SEQ ID NO: 11503 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (3)..(3): base is a locked nucleic acid
gaggytttatyaargtaarr

SEQ ID NO: 11504 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (8)..(8): base is a locked nucleic acid
gaggytttatyaargtaarr

SEQ ID NO: 11505 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (4)..(4): base is a locked nucleic acid
gaggytttatyaargtaarr

SEQ ID NO: 11506 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (11)..(11): base is a locked nucleic acid
gaggytttatyaargtaarr

SEQ ID NO: 11507 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (14)..(14): base is a locked nucleic acid
gaggytttatyaargtaarr

SEQ ID NO: 11508 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (17)..(17): base is a locked nucleic acid
gaggytttatyaargtaarr

SEQ ID NO: 11509 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (12)..(12): base is a locked nucleic acid
gaggytttatyaargtaarr

SEQ ID NO: 11510 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (7)..(7): base is a locked nucleic acid
  modified_base (9)..(9): base is a locked nucleic acid
  modified_base (11)..(11): base is a locked nucleic acid
gaggytttatyaargtaarr

SEQ ID NO: 11511 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (4)..(4): base is a locked nucleic acid
  modified_base (9)..(9): base is a locked nucleic acid
  modified_base (11)..(11): base is a locked nucleic acid
gaggytttatyaargtaarr

SEQ ID NO: 11512 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (3)..(3): base is a locked nucleic acid
  modified_base (9)..(9): base is a locked nucleic acid
  modified_base (11)..(11): base is a locked nucleic acid
gaggytttatyaargtaarr

SEQ ID NO: 11513 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (5)..(5): base is a locked nucleic acid
  modified_base (9)..(9): base is a locked nucleic acid
  modified_base (11)..(11): base is a locked nucleic acid
gaggytttatyaargtaarr

SEQ ID NO: 11514 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (17)..(17): base is a locked nucleic acid
gaggytttatyaargtaarr

SEQ ID NO: 11515 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (16)..(16): base is a locked nucleic acid
gaggytttatyaargtaarr

SEQ ID NO: 11516 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (14)..(14): base is a locked nucleic acid
gaggytttatyaargtaarr

SEQ ID NO: 11517 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (12)..(12): base is a locked nucleic acid
gaggytttatyaargtaarr

SEQ ID NO: 11518 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (4)..(4): base is a locked nucleic acid
ggaggytttatyaargtaar

SEQ ID NO: 11519 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (2)..(2): base is a locked nucleic acid
ggaggytttatyaargtaar

SEQ ID NO: 11520 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (3)..(3): base is a locked nucleic acid
ggaggytttatyaargtaar

SEQ ID NO: 11521 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (7)..(7): base is a locked nucleic acid
ggaggytttatyaargtaar

SEQ ID NO: 11522 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (13)..(13): base is a locked nucleic acid
ggaggytttatyaargtaar

SEQ ID NO: 11523 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (18)..(18): base is a locked nucleic acid
ggaggytttatyaargtaar

SEQ ID NO: 11524 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (17)..(17): base is a locked nucleic acid
ggaggytttatyaargtaar

SEQ ID NO: 11525 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (19)..(19): base is a locked nucleic acid
ggaggytttatyaargtaar

SEQ ID NO: 11526 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (3)..(3): base is a locked nucleic acid
  modified_base (9)..(9): base is a locked nucleic acid
  modified_base (11)..(11): base is a locked nucleic acid
ggaggytttatyaargtaar

SEQ ID NO: 11527 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (2)..(2): base is a locked nucleic acid
  modified_base (9)..(9): base is a locked nucleic acid
  modified_base (11)..(11): base is a locked nucleic acid
ggaggytttatyaargtaar

SEQ ID NO: 11528 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (7)..(7): base is a locked nucleic acid
  modified_base (9)..(9): base is a locked nucleic acid
  modified_base (11)..(11): base is a locked nucleic acid
ggaggytttatyaargtaar

SEQ ID NO: 11529 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (4)..(4): base is a locked nucleic acid
  modified_base (9)..(9): base is a locked nucleic acid
  modified_base (11)..(11): base is a locked nucleic acid
ggaggytttatyaargtaar

SEQ ID NO: 11530 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (15)..(15): base is a locked nucleic acid
ggaggytttatyaargtaar

SEQ ID NO: 11531 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (14)..(14): base is a locked nucleic acid
ggaggytttatyaargtaar

SEQ ID NO: 11532 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (16)..(16): base is a locked nucleic acid
ggaggytttatyaargtaar

SEQ ID NO: 11533 - DNA, 20 bp, Artificial Sequence
  Oligonucleotide probe
  misc_binding (1)..(20): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (13)..(13): base is a locked nucleic acid
ggaggytttatyaargtaar

SEQ ID NO: 11534 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (6)..(6): base is a locked nucleic acid
aggytttatyaargtaarr

SEQ ID NO: 11535 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
aggytttatyaargtaarr

SEQ ID NO: 11536 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (7)..(7): base is a locked nucleic acid
aggytttatyaargtaarr

SEQ ID NO: 11537 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (8)..(8): base is a locked nucleic acid
aggytttatyaargtaarr

SEQ ID NO: 11538 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (11)..(11): base is a locked nucleic acid
aggytttatyaargtaarr

SEQ ID NO: 11539 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (15)..(15): base is a locked nucleic acid
aggytttatyaargtaarr

SEQ ID NO: 11540 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (17)..(17): base is a locked nucleic acid
aggytttatyaargtaarr

SEQ ID NO: 11541 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (13)..(13): base is a locked nucleic acid
aggytttatyaargtaarr

SEQ ID NO: 11542 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (6)..(6): base is a locked nucleic acid
  modified_base (9)..(9): base is a locked nucleic acid
  modified_base (11)..(11): base is a locked nucleic acid
aggytttatyaargtaarr

SEQ ID NO: 11543 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (5)..(5): base is a locked nucleic acid
  modified_base (9)..(9): base is a locked nucleic acid
  modified_base (11)..(11): base is a locked nucleic acid
aggytttatyaargtaarr

SEQ ID NO: 11544 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (4)..(4): base is a locked nucleic acid
  modified_base (9)..(9): base is a locked nucleic acid
  modified_base (11)..(11): base is a locked nucleic acid
aggytttatyaargtaarr

SEQ ID NO: 11545 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (3)..(3): base is a locked nucleic acid
  modified_base (9)..(9): base is a locked nucleic acid
  modified_base (11)..(11): base is a locked nucleic acid
aggytttatyaargtaarr

SEQ ID NO: 11546 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (14)..(14): base is a locked nucleic acid
aggytttatyaargtaarr

SEQ ID NO: 11547 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (19)..(19): base is a locked nucleic acid
aggytttatyaargtaarr

SEQ ID NO: 11548 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (13)..(13): base is a locked nucleic acid
aggytttatyaargtaarr

SEQ ID NO: 11549 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (12)..(12): base is a locked nucleic acid
aggytttatyaargtaarr

SEQ ID NO: 11550 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (7)..(7): base is a locked nucleic acid
gaggytttatyaargtaar

SEQ ID NO: 11551 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (3)..(3): base is a locked nucleic acid
gaggytttatyaargtaar

SEQ ID NO: 11552 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (8)..(8): base is a locked nucleic acid
gaggytttatyaargtaar

SEQ ID NO: 11553 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (4)..(4): base is a locked nucleic acid
gaggytttatyaargtaar

SEQ ID NO: 11554 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (11)..(11): base is a locked nucleic acid
gaggytttatyaargtaar

SEQ ID NO: 11555 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (14)..(14): base is a locked nucleic acid
gaggytttatyaargtaar

SEQ ID NO: 11556 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (17)..(17): base is a locked nucleic acid
gaggytttatyaargtaar

SEQ ID NO: 11557 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (12)..(12): base is a locked nucleic acid
gaggytttatyaargtaar

SEQ ID NO: 11558 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (7)..(7): base is a locked nucleic acid
  modified_base (9)..(9): base is a locked nucleic acid
  modified_base (11)..(11): base is a locked nucleic acid
gaggytttatyaargtaar

SEQ ID NO: 11559 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (4)..(4): base is a locked nucleic acid
  modified_base (9)..(9): base is a locked nucleic acid
  modified_base (11)..(11): base is a locked nucleic acid
gaggytttatyaargtaar

SEQ ID NO: 11560 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (3)..(3): base is a locked nucleic acid
  modified_base (9)..(9): base is a locked nucleic acid
  modified_base (11)..(11): base is a locked nucleic acid
gaggytttatyaargtaar

SEQ ID NO: 11561 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (5)..(5): base is a locked nucleic acid
  modified_base (9)..(9): base is a locked nucleic acid
  modified_base (11)..(11): base is a locked nucleic acid
gaggytttatyaargtaar

SEQ ID NO: 11562 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (17)..(17): base is a locked nucleic acid
gaggytttatyaargtaar

SEQ ID NO: 11563 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (16)..(16): base is a locked nucleic acid
gaggytttatyaargtaar

SEQ ID NO: 11564 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (14)..(14): base is a locked nucleic acid
gaggytttatyaargtaar

SEQ ID NO: 11565 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (12)..(12): base is a locked nucleic acid
gaggytttatyaargtaar

SEQ ID NO: 11566 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (4)..(4): base is a locked nucleic acid
ggaggytttatyaargtaa

SEQ ID NO: 11567 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (2)..(2): base is a locked nucleic acid
ggaggytttatyaargtaa

SEQ ID NO: 11568 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (3)..(3): base is a locked nucleic acid
ggaggytttatyaargtaa

SEQ ID NO: 11569 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (7)..(7): base is a locked nucleic acid
ggaggytttatyaargtaa

SEQ ID NO: 11570 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (13)..(13): base is a locked nucleic acid
ggaggytttatyaargtaa

SEQ ID NO: 11571 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (18)..(18): base is a locked nucleic acid
ggaggytttatyaargtaa

SEQ ID NO: 11572 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (17)..(17): base is a locked nucleic acid
ggaggytttatyaargtaa

SEQ ID NO: 11573 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (19)..(19): base is a locked nucleic acid
ggaggytttatyaargtaa

SEQ ID NO: 11574 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (3)..(3): base is a locked nucleic acid
  modified_base (9)..(9): base is a locked nucleic acid
  modified_base (11)..(11): base is a locked nucleic acid
ggaggytttatyaargtaa

SEQ ID NO: 11575 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (2)..(2): base is a locked nucleic acid
  modified_base (9)..(9): base is a locked nucleic acid
  modified_base (11)..(11): base is a locked nucleic acid
ggaggytttatyaargtaa

SEQ ID NO: 11576 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (7)..(7): base is a locked nucleic acid
  modified_base (9)..(9): base is a locked nucleic acid
  modified_base (11)..(11): base is a locked nucleic acid
ggaggytttatyaargtaa

SEQ ID NO: 11577 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (4)..(4): base is a locked nucleic acid
  modified_base (9)..(9): base is a locked nucleic acid
  modified_base (11)..(11): base is a locked nucleic acid
ggaggytttatyaargtaa

SEQ ID NO: 11578 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (15)..(15): base is a locked nucleic acid
ggaggytttatyaargtaa

SEQ ID NO: 11579 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (14)..(14): base is a locked nucleic acid
ggaggytttatyaargtaa

SEQ ID NO: 11580 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (16)..(16): base is a locked nucleic acid
ggaggytttatyaargtaa

SEQ ID NO: 11581 - DNA, 19 bp, Artificial Sequence
  Oligonucleotide probe
  misc_binding (1)..(19): Hybridization probe for the specific detection of wild-type HIV-1 at codon 54 of the protease gene.
  modified_base (9)..(9): base is a locked nucleic acid
  modified_base (11)..(11): base is a locked nucleic acid
  modified_base (13)..(13): base is a locked nucleic acid
ggaggytttatyaargtaa

SEQ ID NO: 11582 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (5)..(5): base is a locked nucleic acid
ggytttatyaargtaar

SEQ ID NO: 11583 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
ggytttatyaargtaar

SEQ ID NO: 11584 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (6)..(6): base is a locked nucleic acid
ggytttatyaargtaar

SEQ ID NO: 11585 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (7)..(7): base is a locked nucleic acid
ggytttatyaargtaar

SEQ ID NO: 11586 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (10)..(10): base is a locked nucleic acid
ggytttatyaargtaar

SEQ ID NO: 11587 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (14)..(14): base is a locked nucleic acid
ggytttatyaargtaar

SEQ ID NO: 11588 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (16)..(16): base is a locked nucleic acid
ggytttatyaargtaar

SEQ ID NO: 11589 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (12)..(12): base is a locked nucleic acid
ggytttatyaargtaar

SEQ ID NO: 11590 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (5)..(5): base is a locked nucleic acid
  modified_base (8)..(8): base is a locked nucleic acid
  modified_base (10)..(10): base is a locked nucleic acid
ggytttatyaargtaar

SEQ ID NO: 11591 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (4)..(4): base is a locked nucleic acid
  modified_base (8)..(8): base is a locked nucleic acid
  modified_base (10)..(10): base is a locked nucleic acid
ggytttatyaargtaar

SEQ ID NO: 11592 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (3)..(3): base is a locked nucleic acid
  modified_base (8)..(8): base is a locked nucleic acid
  modified_base (10)..(10): base is a locked nucleic acid
ggytttatyaargtaar

SEQ ID NO: 11593 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (2)..(2): base is a locked nucleic acid
  modified_base (8)..(8): base is a locked nucleic acid
  modified_base (10)..(10): base is a locked nucleic acid
ggytttatyaargtaar

SEQ ID NO: 11594 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (13)..(13): base is a locked nucleic acid
ggytttatyaargtaar

SEQ ID NO: 11595 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
ggytttatyaargtaar

SEQ ID NO: 11596 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (12)..(12): base is a locked nucleic acid
ggytttatyaargtaar

SEQ ID NO: 11597 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (11)..(11): base is a locked nucleic acid
ggytttatyaargtaar

SEQ ID NO: 11598 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (6)..(6): base is a locked nucleic acid
aggytttatyaargtaa

SEQ ID NO: 11599 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (2)..(2): base is a locked nucleic acid
aggytttatyaargtaa

SEQ ID NO: 11600 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (7)..(7): base is a locked nucleic acid
aggytttatyaargtaa

SEQ ID NO: 11601 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (3)..(3): base is a locked nucleic acid
aggytttatyaargtaa

SEQ ID NO: 11602 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (10)..(10): base is a locked nucleic acid
aggytttatyaargtaa

SEQ ID NO: 11603 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (13)..(13): base is a locked nucleic acid
aggytttatyaargtaa

SEQ ID NO: 11604 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (16)..(16): base is a locked nucleic acid
aggytttatyaargtaa

SEQ ID NO: 11605 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (11)..(11): base is a locked nucleic acid
aggytttatyaargtaa

SEQ ID NO: 11606 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (6)..(6): base is a locked nucleic acid
  modified_base (8)..(8): base is a locked nucleic acid
  modified_base (10)..(10): base is a locked nucleic acid
aggytttatyaargtaa

SEQ ID NO: 11607 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (3)..(3): base is a locked nucleic acid
  modified_base (8)..(8): base is a locked nucleic acid
  modified_base (10)..(10): base is a locked nucleic acid
aggytttatyaargtaa

SEQ ID NO: 11608 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (2)..(2): base is a locked nucleic acid
  modified_base (8)..(8): base is a locked nucleic acid
  modified_base (10)..(10): base is a locked nucleic acid
aggytttatyaargtaa

SEQ ID NO: 11609 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (4)..(4): base is a locked nucleic acid
  modified_base (8)..(8): base is a locked nucleic acid
  modified_base (10)..(10): base is a locked nucleic acid
aggytttatyaargtaa

SEQ ID NO: 11610 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (16)..(16): base is a locked nucleic acid
aggytttatyaargtaa

SEQ ID NO: 11611 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (15)..(15): base is a locked nucleic acid
aggytttatyaargtaa

SEQ ID NO: 11612 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (13)..(13): base is a locked nucleic acid
aggytttatyaargtaa

SEQ ID NO: 11613 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (11)..(11): base is a locked nucleic acid
aggytttatyaargtaa

SEQ ID NO: 11614 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (3)..(3): base is a locked nucleic acid
gaggytttatyaargta

SEQ ID NO: 11615 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (1)..(1): base is a locked nucleic acid
gaggytttatyaargta

SEQ ID NO: 11616 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (2)..(2): base is a locked nucleic acid
gaggytttatyaargta

SEQ ID NO: 11617 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (6)..(6): base is a locked nucleic acid
gaggytttatyaargta

SEQ ID NO: 11618 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (12)..(12): base is a locked nucleic acid
gaggytttatyaargta

SEQ ID NO: 11619 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (17)..(17): base is a locked nucleic acid
gaggytttatyaargta

SEQ ID NO: 11620 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (16)..(16): base is a locked nucleic acid
gaggytttatyaargta

SEQ ID NO: 11621 - DNA, 17 bp, Artificial Sequence
  Oligonucleotide probe
  misc_binding (1)..(17): Hybridization probe for the specific detection of wild-type HIV-1 at codon 54 of the protease gene.
gaggytttatyaargta

SEQ ID NO: 11622 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (2)..(2): base is a locked nucleic acid
  modified_base (8)..(8): base is a locked nucleic acid
  modified_base (10)..(10): base is a locked nucleic acid
gaggytttatyaargta

SEQ ID NO: 11623 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (1)..(1): base is a locked nucleic acid
  modified_base (8)..(8): base is a locked nucleic acid
  modified_base (10)..(10): base is a locked nucleic acid
gaggytttatyaargta

SEQ ID NO: 11624 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (6)..(6): base is a locked nucleic acid
  modified_base (8)..(8): base is a locked nucleic acid
  modified_base (10)..(10): base is a locked nucleic acid
gaggytttatyaargta

SEQ ID NO: 11625 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (3)..(3): base is a locked nucleic acid
  modified_base (8)..(8): base is a locked nucleic acid
  modified_base (10)..(10): base is a locked nucleic acid
gaggytttatyaargta

SEQ ID NO: 11626 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (14)..(14): base is a locked nucleic acid
gaggytttatyaargta

SEQ ID NO: 11627 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (13)..(13): base is a locked nucleic acid
gaggytttatyaargta

SEQ ID NO: 11628 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (15)..(15): base is a locked nucleic acid
gaggytttatyaargta

SEQ ID NO: 11629 - DNA, 17 bp, Artificial Sequence
  Oligonucleotide probe
  misc_binding (1)..(17): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (12)..(12): base is a locked nucleic acid
gaggytttatyaargta

SEQ ID NO: 11630 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (5)..(5): base is a locked nucleic acid
ggytttatyaargta

SEQ ID NO: 11631 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
ggytttatyaargta

SEQ ID NO: 11632 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (6)..(6): base is a locked nucleic acid
ggytttatyaargta

SEQ ID NO: 11633 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (7)..(7): base is a locked nucleic acid
ggytttatyaargta

SEQ ID NO: 11634 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (10)..(10): base is a locked nucleic acid
ggytttatyaargta

SEQ ID NO: 11635 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (14)..(14): base is a locked nucleic acid
ggytttatyaargta

SEQ ID NO: 11636 - DNA, 15 bp, Artificial Sequence
  Oligonucleotide probe
  misc_binding (1)..(15): Hybridization probe for the specific detection of wild-type HIV-1 at codon 54 of the protease gene.
ggytttatyaargta

SEQ ID NO: 11637 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (12)..(12): base is a locked nucleic acid
ggytttatyaargta

SEQ ID NO: 11638 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (5)..(5): base is a locked nucleic acid
  modified_base (8)..(8): base is a locked nucleic acid
  modified_base (10)..(10): base is a locked nucleic acid
ggytttatyaargta

SEQ ID NO: 11639 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (4)..(4): base is a locked nucleic acid
  modified_base (8)..(8): base is a locked nucleic acid
  modified_base (10)..(10): base is a locked nucleic acid
ggytttatyaargta

SEQ ID NO: 11640 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (3)..(3): base is a locked nucleic acid
  modified_base (8)..(8): base is a locked nucleic acid
  modified_base (10)..(10): base is a locked nucleic acid
ggytttatyaargta

SEQ ID NO: 11641 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (2)..(2): base is a locked nucleic acid
  modified_base (8)..(8): base is a locked nucleic acid
  modified_base (10)..(10): base is a locked nucleic acid
ggytttatyaargta

SEQ ID NO: 11642 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (13)..(13): base is a locked nucleic acid
ggytttatyaargta

SEQ ID NO: 11643 - DNA, 16 bp, Artificial Sequence
  Oligonucleotide probe
  misc_binding (1)..(16): Hybridization probe for the specific detection of wild-type HIV-1 at codon 54 of the protease gene.
  modified_base (8)..(8): base is a locked nucleic acid
  modified_base (10)..(10): base is a locked nucleic acid
ggytttatyaargtaa

SEQ ID NO: 11644 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (12)..(12): base is a locked nucleic acid
ggytttatyaargta

SEQ ID NO: 11645 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (11)..(11): base is a locked nucleic acid
ggytttatyaargta

SEQ ID NO: 11646 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (6)..(6): base is a locked nucleic acid
aggytttatyaargt

SEQ ID NO: 11647 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (2)..(2): base is a locked nucleic acid
aggytttatyaargt

SEQ ID NO: 11648 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (7)..(7): base is a locked nucleic acid
aggytttatyaargt

SEQ ID NO: 11649 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (3)..(3): base is a locked nucleic acid
aggytttatyaargt

SEQ ID NO: 11650 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (10)..(10): base is a locked nucleic acid
aggytttatyaargt

SEQ ID NO: 11651 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (13)..(13): base is a locked nucleic acid
aggytttatyaargt

SEQ ID NO: 11652 - DNA, 15 bp, Artificial Sequence
  Oligonucleotide probe
  misc_binding (1)..(15): Hybridization probe for the specific detection of wild-type HIV-1 at codon 54 of the protease gene.
aggytttatyaargt

SEQ ID NO: 11653 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (11)..(11): base is a locked nucleic acid
aggytttatyaargt

SEQ ID NO: 11654 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (6)..(6): base is a locked nucleic acid
  modified_base (8)..(8): base is a locked nucleic acid
  modified_base (10)..(10): base is a locked nucleic acid
aggytttatyaargt

SEQ ID NO: 11655 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (3)..(3): base is a locked nucleic acid
  modified_base (8)..(8): base is a locked nucleic acid
  modified_base (10)..(10): base is a locked nucleic acid
aggytttatyaargt

SEQ ID NO: 11656 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (2)..(2): base is a locked nucleic acid
  modified_base (8)..(8): base is a locked nucleic acid
  modified_base (10)..(10): base is a locked nucleic acid
aggytttatyaargt

SEQ ID NO: 11657 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (4)..(4): base is a locked nucleic acid
  modified_base (8)..(8): base is a locked nucleic acid
  modified_base (10)..(10): base is a locked nucleic acid
aggytttatyaargt

SEQ ID NO: 11658 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
aggytttatyaargt

SEQ ID NO: 11659 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (15)..(15): base is a locked nucleic acid
aggytttatyaargt

SEQ ID NO: 11660 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (13)..(13): base is a locked nucleic acid
aggytttatyaargt

SEQ ID NO: 11661 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (11)..(11): base is a locked nucleic acid
aggytttatyaargt

SEQ ID NO: 11662 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (3)..(3): base is a locked nucleic acid
gaggytttatyaarg

SEQ ID NO: 11663 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (1)..(1): base is a locked nucleic acid
gaggytttatyaarg

SEQ ID NO: 11664 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (2)..(2): base is a locked nucleic acid
gaggytttatyaarg

SEQ ID NO: 11665 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (6)..(6): base is a locked nucleic acid
gaggytttatyaarg

SEQ ID NO: 11666 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (12)..(12): base is a locked nucleic acid
gaggytttatyaarg

SEQ ID NO: 11667 - DNA, 16 bp, Artificial Sequence
  Oligonucleotide probe
  misc_binding (1)..(16): Hybridization probe for the specific detection of wild-type HIV-1 at codon 54 of the protease gene.
gaggytttatyaargt

SEQ ID NO: 11668 - DNA, 15 bp, Artificial Sequence
  Oligonucleotide probe
  misc_binding (1)..(15): Hybridization probe for the specific detection of wild-type HIV-1 at codon 54 of the protease gene.
gaggytttatyaarg

SEQ ID NO: 11669 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (2)..(2): base is a locked nucleic acid
  modified_base (8)..(8): base is a locked nucleic acid
  modified_base (10)..(10): base is a locked nucleic acid
gaggytttatyaarg

SEQ ID NO: 11670 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (1)..(1): base is a locked nucleic acid
  modified_base (8)..(8): base is a locked nucleic acid
  modified_base (10)..(10): base is a locked nucleic acid
gaggytttatyaarg

SEQ ID NO: 11671 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (6)..(6): base is a locked nucleic acid
  modified_base (8)..(8): base is a locked nucleic acid
  modified_base (10)..(10): base is a locked nucleic acid
gaggytttatyaarg

SEQ ID NO: 11672 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (3)..(3): base is a locked nucleic acid
  modified_base (8)..(8): base is a locked nucleic acid
  modified_base (10)..(10): base is a locked nucleic acid
gaggytttatyaarg

SEQ ID NO: 11673 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (14)..(14): base is a locked nucleic acid
gaggytttatyaarg

SEQ ID NO: 11674 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (13)..(13): base is a locked nucleic acid
gaggytttatyaarg

SEQ ID NO: 11675 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (15)..(15): base is a locked nucleic acid
gaggytttatyaarg

SEQ ID NO: 11676 - DNA, 15 bp, Artificial Sequence
  Oligonucleotide probe
  misc_binding (1)..(15): Hybridization probe for the specific detection of wild-type HIV-1 at codon 54 of the protease gene.
  modified_base (8)..(8): base is a locked nucleic acid
  modified_base (10)..(10): base is a locked nucleic acid
  modified_base (12)..(12): base is a locked nucleic acid
gaggytttatyaarg

SEQ ID NO: 11677 - DNA, 15 bp, Artificial Sequence
  Oligonucleotide probe
  misc_binding (1)..(15): Hybridization probe for the specific detection of wild-type HIV-1 at codon 54 of the protease gene.
tactttrataaaacc

SEQ ID NO: 11678 - DNA, 20 bp, Artificial Sequence
  Oligonucleotide probe
  misc_binding (1)..(20): Hybridization probe for the specific detection of wild-type HIV-1 at codon 54 of the protease gene.
aggytttatyaargtaarrc

SEQ ID NO: 11679 - DNA, 20 bp, Artificial Sequence
  Oligonucleotide probe
  misc_binding (1)..(20): Hybridization probe for the specific detection of wild-type HIV-1 at codon 54 of the protease gene.
gaggytttatyaargtaarr

SEQ ID NO: 11680 - DNA, 20 bp, Artificial Sequence
  Oligonucleotide probe
  misc_binding (1)..(20): Hybridization probe for the specific detection of wild-type HIV-1 at codon 54 of the protease gene.
ggaggytttatyaargtaar

SEQ ID NO: 11681 - DNA, 19 bp, Artificial Sequence
  Oligonucleotide probe
  misc_binding (1)..(19): Hybridization probe for the specific detection of wild-type HIV-1 at codon 54 of the protease gene.
aggytttatyaargtaarr

SEQ ID NO: 11682 - DNA, 19 bp, Artificial Sequence
  Oligonucleotide probe
  misc_binding (1)..(19): Hybridization probe for the specific detection of wild-type HIV-1 at codon 54 of the protease gene.
gaggytttatyaargtaar

SEQ ID NO: 11683 - DNA, 19 bp, Artificial Sequence
  Oligonucleotide probe
  misc_binding (1)..(19): Hybridization probe for the specific detection of wild-type HIV-1 at codon 54 of the protease gene.
ggaggytttatyaargtaa

SEQ ID NO: 11684 - DNA, 17 bp, Artificial Sequence
  Oligonucleotide probe
  misc_binding (1)..(17): Hybridization probe for the specific detection of wild-type HIV-1 at codon 54 of the protease gene.
ggytttatyaargtaar

SEQ ID NO: 11685 - DNA, 17 bp, Artificial Sequence
  Oligonucleotide probe
  misc_binding (1)..(17): Hybridization probe for the specific detection of wild-type HIV-1 at codon 54 of the protease gene.
aggytttatyaargtaa

SEQ ID NO: 11686 - DNA, 17 bp, Artificial Sequence
  Oligonucleotide probe
  misc_binding (1)..(17): Hybridization probe for the specific detection of wild-type HIV-1 at codon 54 of the protease gene.
gaggytttatyaargta

SEQ ID NO: 11687 - DNA, 15 bp, Artificial Sequence
  Oligonucleotide probe
  misc_binding (1)..(15): Hybridization probe for the specific detection of wild-type HIV-1 at codon 54 of the protease gene.
ggytttatyaargta

SEQ ID NO: 11688 - DNA, 16 bp, Artificial Sequence
  Oligonucleotide probe
  misc_binding (1)..(16): Hybridization probe for the specific detection of wild-type HIV-1 at codon 54 of the protease gene.
ggytttatyaargtaa

SEQ ID NO: 11689 - DNA, 15 bp, Artificial Sequence
  Oligonucleotide probe
  misc_binding (1)..(15): Hybridization probe for the specific detection of wild-type HIV-1 at codon 54 of the protease gene.
aggytttatyaargt

SEQ ID NO: 11690 - DNA, 15 bp, Artificial Sequence
  Oligonucleotide probe
  misc_binding (1)..(15): Hybridization probe for the specific detection of wild-type HIV-1 at codon 54 of the protease gene.
gaggytttatyaarg

SEQ ID NO: 11691 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (3)..(3): base is a locked nucleic acid
aargtaarrcartatgaksa

SEQ ID NO: 11692 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (8)..(8): base is a locked nucleic acid
aargtaarrcartatgaksa

SEQ ID NO: 11693 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (2)..(2): base is a locked nucleic acid
aargtaarrcartatgaksa

SEQ ID NO: 11694 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (9)..(9): base is a locked nucleic acid
aargtaarrcartatgaksa

SEQ ID NO: 11695 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (14)..(14): base is a locked nucleic acid
aargtaarrcartatgaksa

SEQ ID NO: 11696 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (19)..(19): base is a locked nucleic acid
aargtaarrcartatgaksa

SEQ ID NO: 11697 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (12)..(12): base is a locked nucleic acid
aargtaarrcartatgaksa

SEQ ID NO: 11698 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (13)..(13): base is a locked nucleic acid
aargtaarrcartatgaksa

SEQ ID NO: 11699 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (3)..(3): base is a locked nucleic acid
  modified_base (9)..(9): base is a locked nucleic acid
  modified_base (11)..(11): base is a locked nucleic acid
aargtaarrcartatgaksa

SEQ ID NO: 11700 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (5)..(5): base is a locked nucleic acid
  modified_base (9)..(9): base is a locked nucleic acid
  modified_base (11)..(11): base is a locked nucleic acid
aargtaarrcartatgaksa

SEQ ID NO: 11701 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (4)..(4): base is a locked nucleic acid
  modified_base (9)..(9): base is a locked nucleic acid
  modified_base (11)..(11): base is a locked nucleic acid
aargtaarrcartatgaksa

SEQ ID NO: 11702 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (2)..(2): base is a locked nucleic acid
  modified_base (9)..(9): base is a locked nucleic acid
  modified_base (11)..(11): base is a locked nucleic acid
aargtaarrcartatgaksa

SEQ ID NO: 11703 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (19)..(19): base is a locked nucleic acid
aargtaarrcartatgaksa

SEQ ID NO: 11704 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (16)..(16): base is a locked nucleic acid
aargtaarrcartatgaksa

SEQ ID NO: 11705 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (15)..(15): base is a locked nucleic acid
aargtaarrcartatgaksa

SEQ ID NO: 11706 - DNA, 20 bp, Artificial Sequence
  Oligonucleotide probe
  misc_binding (1)..(20): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (13)..(13): base is a locked nucleic acid
aargtaarrcartatgaksa

SEQ ID NO: 11707 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (3)..(3): base is a locked nucleic acid
aargtaarrcartatgaks

SEQ ID NO: 11708 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (8)..(8): base is a locked nucleic acid
aargtaarrcartatgaks

SEQ ID NO: 11709 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (2)..(2): base is a locked nucleic acid
aargtaarrcartatgaks

SEQ ID NO: 11710 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (9)..(9): base is a locked nucleic acid
aargtaarrcartatgaks

SEQ ID NO: 11711 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (14)..(14): base is a locked nucleic acid
aargtaarrcartatgaks

SEQ ID NO: 11712 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (19)..(19): base is a locked nucleic acid
aargtaarrcartatgaks

SEQ ID NO: 11713 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (12)..(12): base is a locked nucleic acid
aargtaarrcartatgaks

SEQ ID NO: 11714 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (13)..(13): base is a locked nucleic acid
aargtaarrcartatgaks

SEQ ID NO: 11715 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (3)..(3): base is a locked nucleic acid
  modified_base (9)..(9): base is a locked nucleic acid
  modified_base (11)..(11): base is a locked nucleic acid
aargtaarrcartatgaks

SEQ ID NO: 11716 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (5)..(5): base is a locked nucleic acid
  modified_base (9)..(9): base is a locked nucleic acid
  modified_base (11)..(11): base is a locked nucleic acid
aargtaarrcartatgaks

SEQ ID NO: 11717 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (4)..(4): base is a locked nucleic acid
  modified_base (9)..(9): base is a locked nucleic acid
  modified_base (11)..(11): base is a locked nucleic acid
aargtaarrcartatgaks

SEQ ID NO: 11718 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (2)..(2): base is a locked nucleic acid
  modified_base (9)..(9): base is a locked nucleic acid
  modified_base (11)..(11): base is a locked nucleic acid
aargtaarrcartatgaks

SEQ ID NO: 11719 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (19)..(19): base is a locked nucleic acid
aargtaarrcartatgaks

SEQ ID NO: 11720 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (16)..(16): base is a locked nucleic acid
aargtaarrcartatgaks

SEQ ID NO: 11721 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (15)..(15): base is a locked nucleic acid
aargtaarrcartatgaks

SEQ ID NO: 11722 - DNA, 19 bp, Artificial Sequence
  Oligonucleotide probe
  misc_binding (1)..(19): Hybridization probe for the specific detection of wild-type HIV-1 at codon 58 of the protease gene.
  modified_base (9)..(9): base is a locked nucleic acid
  modified_base (11)..(11): base is a locked nucleic acid
  modified_base (13)..(13): base is a locked nucleic acid
aargtaarrcartatgaks

SEQ ID NO: 11723 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (2)..(2): base is a locked nucleic acid
argtaarrcartatgak

SEQ ID NO: 11724 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (7)..(7): base is a locked nucleic acid
argtaarrcartatgak

SEQ ID NO: 11725 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (1)..(1): base is a locked nucleic acid
argtaarrcartatgak

SEQ ID NO: 11726 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (8)..(8): base is a locked nucleic acid
argtaarrcartatgak

SEQ ID NO: 11727 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (13)..(13): base is a locked nucleic acid
argtaarrcartatgak

SEQ ID NO: 11728 - DNA, 17 bp, Artificial Sequence
  Oligonucleotide probe
  misc_binding (1)..(17): Hybridization probe for the specific detection of wild-type HIV-1 at codon 58 of the protease gene.
argtaarrcartatgak

SEQ ID NO: 11729 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (11)..(11): base is a locked nucleic acid
argtaarrcartatgak

SEQ ID NO: 11730 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (12)..(12): base is a locked nucleic acid
argtaarrcartatgak

SEQ ID NO: 11731 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (2)..(2): base is a locked nucleic acid
  modified_base (8)..(8): base is a locked nucleic acid
  modified_base (10)..(10): base is a locked nucleic acid
argtaarrcartatgak

SEQ ID NO: 11732 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (4)..(4): base is a locked nucleic acid
  modified_base (8)..(8): base is a locked nucleic acid
  modified_base (10)..(10): base is a locked nucleic acid
argtaarrcartatgak

SEQ ID NO: 11733 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (3)..(3): base is a locked nucleic acid
  modified_base (8)..(8): base is a locked nucleic acid
  modified_base (10)..(10): base is a locked nucleic acid
argtaarrcartatgak

SEQ ID NO: 11734 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (1)..(1): base is a locked nucleic acid
  modified_base (8)..(8): base is a locked nucleic acid
  modified_base (10)..(10): base is a locked nucleic acid
argtaarrcartatgak

SEQ ID NO: 11735 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (8)..(8): base is a locked nucleic acid
  modified_base (10)..(10): base is a locked nucleic acid
argtaarrcartatgak

SEQ ID NO: 11736 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (8)..(8): base is a locked nucleic acid
  modified_base (10)..(10): base is a locked nucleic acid
  modified_base (15)..(15): base is a locked nucleic acid
argtaarrcartatgak

SEQ ID NO: 11737 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (8)..(8): base is a locked nucleic acid
  modified_base (10)..(10): base is a locked nucleic acid
  modified_base (14)..(14): base is a locked nucleic acid
argtaarrcartatgak

SEQ ID NO: 11738 - DNA, 17 bp, Artificial Sequence
  Oligonucleotide probe
  misc_binding (1)..(17): Hybridization probe for the specific detection of wild-type HIV-1 at codon 58 of the protease gene.
  modified_base (8)..(8): base is a locked nucleic acid
  modified_base (10)..(10): base is a locked nucleic acid
  modified_base (12)..(12): base is a locked nucleic acid
argtaarrcartatgak

SEQ ID NO: 11739 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (2)..(2): base is a locked nucleic acid
argtaarrcartatg

SEQ ID NO: 11740 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (7)..(7): base is a locked nucleic acid
argtaarrcartatg

SEQ ID NO: 11741 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (1)..(1): base is a locked nucleic acid
argtaarrcartatg

SEQ ID NO: 11742 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (8)..(8): base is a locked nucleic acid
argtaarrcartatg

SEQ ID NO: 11743 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (13)..(13): base is a locked nucleic acid
argtaarrcartatg

SEQ ID NO: 11744 - DNA, 16 bp, Artificial Sequence
  Oligonucleotide probe
  misc_binding (1)..(16): Hybridization probe for the specific detection of wild-type HIV-1 at codon 58 of the protease gene.
argtaarrcartatga

SEQ ID NO: 11745 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (11)..(11): base is a locked nucleic acid
argtaarrcartatg

SEQ ID NO: 11746 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (12)..(12): base is a locked nucleic acid
argtaarrcartatg

SEQ ID NO: 11747 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (2)..(2): base is a locked nucleic acid
  modified_base (8)..(8): base is a locked nucleic acid
  modified_base (10)..(10): base is a locked nucleic acid
argtaarrcartatg

SEQ ID NO: 11748 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (4)..(4): base is a locked nucleic acid
  modified_base (8)..(8): base is a locked nucleic acid
  modified_base (10)..(10): base is a locked nucleic acid
argtaarrcartatg

SEQ ID NO: 11749 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (3)..(3): base is a locked nucleic acid
  modified_base (8)..(8): base is a locked nucleic acid
  modified_base (10)..(10): base is a locked nucleic acid
argtaarrcartatg

SEQ ID NO: 11750 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (1)..(1): base is a locked nucleic acid
  modified_base (8)..(8): base is a locked nucleic acid
  modified_base (10)..(10): base is a locked nucleic acid
argtaarrcartatg

SEQ ID NO: 11751 - DNA, 16 bp, Artificial Sequence
  Oligonucleotide probe
  misc_binding (1)..(16): Hybridization probe for the specific detection of wild-type HIV-1 at codon 58 of the protease gene.
  modified_base (8)..(8): base is a locked nucleic acid
  modified_base (10)..(10): base is a locked nucleic acid
argtaarrcartatga

SEQ ID NO: 11752 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (8)..(8): base is a locked nucleic acid
  modified_base (10)..(10): base is a locked nucleic acid
  modified_base (15)..(15): base is a locked nucleic acid
argtaarrcartatg

SEQ ID NO: 11753 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (8)..(8): base is a locked nucleic acid
  modified_base (10)..(10): base is a locked nucleic acid
  modified_base (14)..(14): base is a locked nucleic acid
argtaarrcartatg

SEQ ID NO: 11754 - DNA, 15 bp, Artificial Sequence
  Oligonucleotide probe
  misc_binding (1)..(15): Hybridization probe for the specific detection of wild-type HIV-1 at codon 58 of the protease gene.
  modified_base (8)..(8): base is a locked nucleic acid
  modified_base (10)..(10): base is a locked nucleic acid
  modified_base (12)..(12): base is a locked nucleic acid
argtaarrcartatg

SEQ ID NO: 11755 - DNA, 15 bp, Artificial Sequence
  Oligonucleotide probe
  misc_binding (1)..(15): Hybridization probe for the specific detection of wild-type HIV-1 at codon 58 of the protease gene.
agtaagacartatga

SEQ ID NO: 11756 - DNA, 20 bp, Artificial Sequence
  Oligonucleotide probe
  misc_binding (1)..(20): Hybridization probe for the specific detection of wild-type HIV-1 at codon 58 of the protease gene.
aargtaarrcartatgaksa

SEQ ID NO: 11757 - DNA, 19 bp, Artificial Sequence
  Oligonucleotide probe
  misc_binding (1)..(19): Hybridization probe for the specific detection of wild-type HIV-1 at codon 58 of the protease gene.
aargtaarrcartatgaks

SEQ ID NO: 11758 - DNA, 17 bp, Artificial Sequence
  Oligonucleotide probe
  misc_binding (1)..(17): Hybridization probe for the specific detection of wild-type HIV-1 at codon 58 of the protease gene.
argtaarrcartatgak

SEQ ID NO: 11759 - DNA, 15 bp, Artificial Sequence
  Oligonucleotide probe
  misc_binding (1)..(15): Hybridization probe for the specific detection of wild-type HIV-1 at codon 58 of the protease gene.
argtaarrcartatg

SEQ ID NO: 11760 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (2)..(2): base is a locked nucleic acid
ggrmawarrgcyataggkwc

SEQ ID NO: 11761 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (7)..(7): base is a locked nucleic acid
ggrmawarrgcyataggkwc

SEQ ID NO: 11762 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (4)..(4): base is a locked nucleic acid
ggrmawarrgcyataggkwc

SEQ ID NO: 11763 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (5)..(5): base is a locked nucleic acid
ggrmawarrgcyataggkwc

SEQ ID NO: 11764 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (16)..(16): base is a locked nucleic acid
ggrmawarrgcyataggkwc

SEQ ID NO: 11765 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (17)..(17): base is a locked nucleic acid
ggrmawarrgcyataggkwc

SEQ ID NO: 11766 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (11)..(11): base is a locked nucleic acid
ggrmawarrgcyataggkwc

SEQ ID NO: 11767 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (12)..(12): base is a locked nucleic acid
ggrmawarrgcyataggkwc

SEQ ID NO: 11768 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (2)..(2): base is a locked nucleic acid
  modified_base (9)..(9): base is a locked nucleic acid
  modified_base (11)..(11): base is a locked nucleic acid
ggrmawarrgcyataggkwc

SEQ ID NO: 11769 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (8)..(8): base is a locked nucleic acid
  modified_base (9)..(9): base is a locked nucleic acid
  modified_base (11)..(11): base is a locked nucleic acid
ggrmawarrgcyataggkwc

SEQ ID NO: 11770 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (3)..(3): base is a locked nucleic acid
  modified_base (9)..(9): base is a locked nucleic acid
  modified_base (11)..(11): base is a locked nucleic acid
ggrmawarrgcyataggkwc

SEQ ID NO: 11771 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (7)..(7): base is a locked nucleic acid
  modified_base (9)..(9): base is a locked nucleic acid
  modified_base (11)..(11): base is a locked nucleic acid
ggrmawarrgcyataggkwc

SEQ ID NO: 11772 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (12)..(12): base is a locked nucleic acid
ggrmawarrgcyataggkwc

SEQ ID NO: 11773 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (15)..(15): base is a locked nucleic acid
ggrmawarrgcyataggkwc

SEQ ID NO: 11774 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (18)..(18): base is a locked nucleic acid
ggrmawarrgcyataggkwc

SEQ ID NO: 11775 - DNA, 20 bp, Artificial Sequence
  Oligonucleotide probe
  misc_binding (1)..(20): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (14)..(14): base is a locked nucleic acid
ggrmawarrgcyataggkwc

SEQ ID NO: 11776 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (2)..(2): base is a locked nucleic acid
ggrmawarrgcyataggkw

SEQ ID NO: 11777 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (7)..(7): base is a locked nucleic acid
ggrmawarrgcyataggkw

SEQ ID NO: 11778 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (4)..(4): base is a locked nucleic acid
ggrmawarrgcyataggkw

SEQ ID NO: 11779 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (5)..(5): base is a locked nucleic acid
ggrmawarrgcyataggkw

SEQ ID NO: 11780 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (16)..(16): base is a locked nucleic acid
ggrmawarrgcyataggkw

SEQ ID NO: 11781 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (17)..(17): base is a locked nucleic acid
ggrmawarrgcyataggkw

SEQ ID NO: 11782 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (11)..(11): base is a locked nucleic acid
ggrmawarrgcyataggkw

SEQ ID NO: 11783 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (12)..(12): base is a locked nucleic acid
ggrmawarrgcyataggkw

SEQ ID NO: 11784 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (2)..(2): base is a locked nucleic acid
  modified_base (9)..(9): base is a locked nucleic acid
  modified_base (11)..(11): base is a locked nucleic acid
ggrmawarrgcyataggkw

SEQ ID NO: 11785 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (8)..(8): base is a locked nucleic acid
  modified_base (9)..(9): base is a locked nucleic acid
  modified_base (11)..(11): base is a locked nucleic acid
ggrmawarrgcyataggkw

SEQ ID NO: 11786 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (3)..(3): base is a locked nucleic acid
  modified_base (9)..(9): base is a locked nucleic acid
  modified_base (11)..(11): base is a locked nucleic acid
ggrmawarrgcyataggkw

SEQ ID NO: 11787 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (7)..(7): base is a locked nucleic acid
  modified_base (9)..(9): base is a locked nucleic acid
  modified_base (11)..(11): base is a locked nucleic acid
ggrmawarrgcyataggkw

SEQ ID NO: 11788 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (12)..(12): base is a locked nucleic acid
ggrmawarrgcyataggkw

SEQ ID NO: 11789 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (15)..(15): base is a locked nucleic acid
ggrmawarrgcyataggkw

SEQ ID NO: 11790 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (18)..(18): base is a locked nucleic acid
ggrmawarrgcyataggkw

SEQ ID NO: 11791 - DNA, 19 bp, Artificial Sequence
  Oligonucleotide probe
  misc_binding (1)..(19): Hybridization probe for the specific detection of wild-type HIV-1 at codon 71 of the protease gene.
  modified_base (9)..(9): base is a locked nucleic acid
  modified_base (11)..(11): base is a locked nucleic acid
  modified_base (14)..(14): base is a locked nucleic acid
ggrmawarrgcyataggkw

SEQ ID NO: 11792 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (1)..(1): base is a locked nucleic acid
grmawarrgcyataggk

SEQ ID NO: 11793 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (6)..(6): base is a locked nucleic acid
grmawarrgcyataggk

SEQ ID NO: 11794 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (3)..(3): base is a locked nucleic acid
grmawarrgcyataggk

SEQ ID NO: 11795 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (4)..(4): base is a locked nucleic acid
grmawarrgcyataggk

SEQ ID NO: 11796 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (15)..(15): base is a locked nucleic acid
grmawarrgcyataggk

SEQ ID NO: 11797 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (16)..(16): base is a locked nucleic acid
grmawarrgcyataggk

SEQ ID NO: 11798 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (10)..(10): base is a locked nucleic acid
grmawarrgcyataggk

SEQ ID NO: 11799 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (11)..(11): base is a locked nucleic acid
grmawarrgcyataggk

SEQ ID NO: 11800 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (1)..(1): base is a locked nucleic acid
  modified_base (8)..(8): base is a locked nucleic acid
  modified_base (10)..(10): base is a locked nucleic acid
grmawarrgcyataggk

SEQ ID NO: 11801 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (7)..(7): base is a locked nucleic acid
  modified_base (8)..(8): base is a locked nucleic acid
  modified_base (10)..(10): base is a locked nucleic acid
grmawarrgcyataggk

SEQ ID NO: 11802 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (2)..(2): base is a locked nucleic acid
  modified_base (8)..(8): base is a locked nucleic acid
  modified_base (10)..(10): base is a locked nucleic acid
grmawarrgcyataggk

SEQ ID NO: 11803 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (6)..(6): base is a locked nucleic acid
  modified_base (8)..(8): base is a locked nucleic acid
  modified_base (10)..(10): base is a locked nucleic acid
grmawarrgcyataggk

SEQ ID NO: 11804 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (8)..(8): base is a locked nucleic acid
  modified_base (10)..(10): base is a locked nucleic acid
  modified_base (11)..(11): base is a locked nucleic acid
grmawarrgcyataggk

SEQ ID NO: 11805 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (8)..(8): base is a locked nucleic acid
  modified_base (10)..(10): base is a locked nucleic acid
  modified_base (14)..(14): base is a locked nucleic acid
grmawarrgcyataggk

SEQ ID NO: 11806 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (8)..(8): base is a locked nucleic acid
  modified_base (10)..(10): base is a locked nucleic acid
  modified_base (17)..(17): base is a locked nucleic acid
grmawarrgcyataggk

SEQ ID NO: 11807 - DNA, 17 bp, Artificial Sequence
  Oligonucleotide probe
  misc_binding (1)..(17): Hybridization probe for the specific detection of wild-type HIV-1 at codon 71 of the protease gene.
  modified_base (8)..(8): base is a locked nucleic acid
  modified_base (10)..(10): base is a locked nucleic acid
  modified_base (13)..(13): base is a locked nucleic acid
grmawarrgcyataggk

SEQ ID NO: 11808 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (1)..(1): base is a locked nucleic acid
grmawarrgcyatag

SEQ ID NO: 11809 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (6)..(6): base is a locked nucleic acid
grmawarrgcyatag

SEQ ID NO: 11810 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (3)..(3): base is a locked nucleic acid
grmawarrgcyatag

SEQ ID NO: 11811 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (4)..(4): base is a locked nucleic acid
grmawarrgcyatag

SEQ ID NO: 11812 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (15)..(15): base is a locked nucleic acid
grmawarrgcyatag

SEQ ID NO: 11813 - DNA, 15 bp, Artificial Sequence
  Oligonucleotide probe
  misc_binding (1)..(15): Hybridization probe for the specific detection of wild-type HIV-1 at codon 71 of the protease gene.
grmawarrgcyatag

SEQ ID NO: 11814 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (10)..(10): base is a locked nucleic acid
grmawarrgcyatag

SEQ ID NO: 11815 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (11)..(11): base is a locked nucleic acid
grmawarrgcyatag

SEQ ID NO: 11816 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (1)..(1): base is a locked nucleic acid
  modified_base (8)..(8): base is a locked nucleic acid
  modified_base (10)..(10): base is a locked nucleic acid
grmawarrgcyatag

SEQ ID NO: 11817 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (7)..(7): base is a locked nucleic acid
  modified_base (8)..(8): base is a locked nucleic acid
  modified_base (10)..(10): base is a locked nucleic acid
grmawarrgcyatag

SEQ ID NO: 11818 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (2)..(2): base is a locked nucleic acid
  modified_base (8)..(8): base is a locked nucleic acid
  modified_base (10)..(10): base is a locked nucleic acid
grmawarrgcyatag

SEQ ID NO: 11819 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (6)..(6): base is a locked nucleic acid
  modified_base (8)..(8): base is a locked nucleic acid
  modified_base (10)..(10): base is a locked nucleic acid
grmawarrgcyatag

SEQ ID NO: 11820 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (8)..(8): base is a locked nucleic acid
  modified_base (10)..(10): base is a locked nucleic acid
  modified_base (11)..(11): base is a locked nucleic acid
grmawarrgcyatag

SEQ ID NO: 11821 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (8)..(8): base is a locked nucleic acid
  modified_base (10)..(10): base is a locked nucleic acid
  modified_base (14)..(14): base is a locked nucleic acid
grmawarrgcyatag

SEQ ID NO: 11822 - DNA, 16 bp, Artificial Sequence
  Oligonucleotide probe
  misc_binding (1)..(16): Hybridization probe for the specific detection of wild-type HIV-1 at codon 71 of the protease gene.
  modified_base (8)..(8): base is a locked nucleic acid
  modified_base (10)..(10): base is a locked nucleic acid
grmawarrgcyatagg

SEQ ID NO: 11823 - DNA, 15 bp, Artificial Sequence
  Oligonucleotide probe
  misc_binding (1)..(15): Hybridization probe for the specific detection of wild-type HIV-1 at codon 71 of the protease gene.
  modified_base (8)..(8): base is a locked nucleic acid
  modified_base (10)..(10): base is a locked nucleic acid
  modified_base (13)..(13): base is a locked nucleic acid
grmawarrgcyatag

SEQ ID NO: 11824 - DNA, 15 bp, Artificial Sequence
  Oligonucleotide probe
  misc_binding (1)..(15): Hybridization probe for the specific detection of wild-type HIV-1 at codon 71 of the protease gene.
cataaagchataggt

SEQ ID NO: 11825 - DNA, 20 bp, Artificial Sequence
  Oligonucleotide probe
  misc_binding (1)..(20): Hybridization probe for the specific detection of wild-type HIV-1 at codon 71 of the protease gene.
ggrmawarrgcyataggkwc

SEQ ID NO: 11826 - DNA, 19 bp, Artificial Sequence
  Oligonucleotide probe
  misc_binding (1)..(19): Hybridization probe for the specific detection of wild-type HIV-1 at codon 71 of the protease gene.
ggrmawarrgcyataggkw

SEQ ID NO: 11827 - DNA, 17 bp, Artificial Sequence
  Oligonucleotide probe
  misc_binding (1)..(17): Hybridization probe for the specific detection of wild-type HIV-1 at codon 71 of the protease gene.
grmawarrgcyataggk

SEQ ID NO: 11828 - DNA, 15 bp, Artificial Sequence
  Oligonucleotide probe
  misc_binding (1)..(15): Hybridization probe for the specific detection of wild-type HIV-1 at codon 71 of the protease gene.
grmawarrgcyatag

SEQ ID NO: 11829 - DNA, 16 bp, Artificial Sequence
  Oligonucleotide probe
  misc_binding (1)..(16): Hybridization probe for the specific detection of wild-type HIV-1 at codon 71 of the protease gene.
grmawarrgcyatagg

SEQ ID NO: 11830 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (4)..(4): base is a locked nucleic acid
rrgcyataggkwcagtrytr

SEQ ID NO: 11831 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (2)..(2): base is a locked nucleic acid
rrgcyataggkwcagtrytr

SEQ ID NO: 11832 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (5)..(5): base is a locked nucleic acid
rrgcyataggkwcagtrytr

SEQ ID NO: 11833 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (8)..(8): base is a locked nucleic acid
rrgcyataggkwcagtrytr

SEQ ID NO: 11834 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (19)..(19): base is a locked nucleic acid
rrgcyataggkwcagtrytr

SEQ ID NO: 11835 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (11)..(11): base is a locked nucleic acid
rrgcyataggkwcagtrytr

SEQ ID NO: 11836 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (14)..(14): base is a locked nucleic acid
rrgcyataggkwcagtrytr

SEQ ID NO: 11837 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (12)..(12): base is a locked nucleic acid
rrgcyataggkwcagtrytr

SEQ ID NO: 11838 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
rrgcyataggkwcagtrytr

SEQ ID NO: 11839 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (6)..(6): base is a locked nucleic acid
  modified_base (9)..(9): base is a locked nucleic acid
  modified_base (11)..(11): base is a locked nucleic acid
rrgcyataggkwcagtrytr

SEQ ID NO: 11840 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (3)..(3): base is a locked nucleic acid
  modified_base (9)..(9): base is a locked nucleic acid
  modified_base (11)..(11): base is a locked nucleic acid
rrgcyataggkwcagtrytr

SEQ ID NO: 11841 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (4)..(4): base is a locked nucleic acid
  modified_base (9)..(9): base is a locked nucleic acid
  modified_base (11)..(11): base is a locked nucleic acid
rrgcyataggkwcagtrytr

SEQ ID NO: 11842 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (14)..(14): base is a locked nucleic acid
rrgcyataggkwcagtrytr

SEQ ID NO: 11843 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (12)..(12): base is a locked nucleic acid
rrgcyataggkwcagtrytr

SEQ ID NO: 11844 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (18)..(18): base is a locked nucleic acid
rrgcyataggkwcagtrytr

SEQ ID NO: 11845 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (13)..(13): base is a locked nucleic acid
rrgcyataggkwcagtrytr

SEQ ID NO: 11846 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (8)..(8): base is a locked nucleic acid
arrgcyataggkwcagtryt

SEQ ID NO: 11847 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (2)..(2): base is a locked nucleic acid
arrgcyataggkwcagtryt

SEQ ID NO: 11848 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (3)..(3): base is a locked nucleic acid
arrgcyataggkwcagtryt

SEQ ID NO: 11849 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (5)..(5): base is a locked nucleic acid
arrgcyataggkwcagtryt

SEQ ID NO: 11850 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (15)..(15): base is a locked nucleic acid
arrgcyataggkwcagtryt

SEQ ID NO: 11851 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (13)..(13): base is a locked nucleic acid
arrgcyataggkwcagtryt

SEQ ID NO: 11852 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (12)..(12): base is a locked nucleic acid
arrgcyataggkwcagtryt

SEQ ID NO: 11853 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (19)..(19): base is a locked nucleic acid
arrgcyataggkwcagtryt

SEQ ID NO: 11854 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
arrgcyataggkwcagtryt

SEQ ID NO: 11855 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (5)..(5): base is a locked nucleic acid
  modified_base (9)..(9): base is a locked nucleic acid
  modified_base (11)..(11): base is a locked nucleic acid
arrgcyataggkwcagtryt

SEQ ID NO: 11856 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (2)..(2): base is a locked nucleic acid
  modified_base (9)..(9): base is a locked nucleic acid
  modified_base (11)..(11): base is a locked nucleic acid
arrgcyataggkwcagtryt

SEQ ID NO: 11857 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (7)..(7): base is a locked nucleic acid
  modified_base (9)..(9): base is a locked nucleic acid
  modified_base (11)..(11): base is a locked nucleic acid
arrgcyataggkwcagtryt

SEQ ID NO: 11858 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (15)..(15): base is a locked nucleic acid
arrgcyataggkwcagtryt

SEQ ID NO: 11859 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (19)..(19): base is a locked nucleic acid
arrgcyataggkwcagtryt

SEQ ID NO: 11860 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (14)..(14): base is a locked nucleic acid
arrgcyataggkwcagtryt

SEQ ID NO: 11861 - DNA, 20 bp, Artificial Sequence
  Oligonucleotide probe
  misc_binding (1)..(20): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (13)..(13): base is a locked nucleic acid
arrgcyataggkwcagtryt

SEQ ID NO: 11862 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (4)..(4): base is a locked nucleic acid
rrgcyataggkwcagtryt

SEQ ID NO: 11863 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (2)..(2): base is a locked nucleic acid
rrgcyataggkwcagtryt

SEQ ID NO: 11864 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (5)..(5): base is a locked nucleic acid
rrgcyataggkwcagtryt

SEQ ID NO: 11865 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (8)..(8): base is a locked nucleic acid
rrgcyataggkwcagtryt

SEQ ID NO: 11866 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (19)..(19): base is a locked nucleic acid
rrgcyataggkwcagtryt

SEQ ID NO: 11867 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (11)..(11): base is a locked nucleic acid
rrgcyataggkwcagtryt

SEQ ID NO: 11868 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (14)..(14): base is a locked nucleic acid
rrgcyataggkwcagtryt

SEQ ID NO: 11869 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (12)..(12): base is a locked nucleic acid
rrgcyataggkwcagtryt

SEQ ID NO: 11870 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
rrgcyataggkwcagtryt

SEQ ID NO: 11871 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (6)..(6): base is a locked nucleic acid
  modified_base (9)..(9): base is a locked nucleic acid
  modified_base (11)..(11): base is a locked nucleic acid
rrgcyataggkwcagtryt

SEQ ID NO: 11872 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (3)..(3): base is a locked nucleic acid
  modified_base (9)..(9): base is a locked nucleic acid
  modified_base (11)..(11): base is a locked nucleic acid
rrgcyataggkwcagtryt

SEQ ID NO: 11873 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (4)..(4): base is a locked nucleic acid
  modified_base (9)..(9): base is a locked nucleic acid
  modified_base (11)..(11): base is a locked nucleic acid
rrgcyataggkwcagtryt

SEQ ID NO: 11874 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (14)..(14): base is a locked nucleic acid
rrgcyataggkwcagtryt

SEQ ID NO: 11875 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (12)..(12): base is a locked nucleic acid
rrgcyataggkwcagtryt

SEQ ID NO: 11876 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (18)..(18): base is a locked nucleic acid
rrgcyataggkwcagtryt

SEQ ID NO: 11877 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (13)..(13): base is a locked nucleic acid
rrgcyataggkwcagtryt

SEQ ID NO: 11878 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (8)..(8): base is a locked nucleic acid
arrgcyataggkwcagtry

SEQ ID NO: 11879 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (2)..(2): base is a locked nucleic acid
arrgcyataggkwcagtry

SEQ ID NO: 11880 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (3)..(3): base is a locked nucleic acid
arrgcyataggkwcagtry

SEQ ID NO: 11881 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (5)..(5): base is a locked nucleic acid
arrgcyataggkwcagtry

SEQ ID NO: 11882 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (15)..(15): base is a locked nucleic acid
arrgcyataggkwcagtry

SEQ ID NO: 11883 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (13)..(13): base is a locked nucleic acid
arrgcyataggkwcagtry

SEQ ID NO: 11884 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (12)..(12): base is a locked nucleic acid
arrgcyataggkwcagtry

SEQ ID NO: 11885 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (19)..(19): base is a locked nucleic acid
arrgcyataggkwcagtry

SEQ ID NO: 11886 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
arrgcyataggkwcagtry

SEQ ID NO: 11887 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (5)..(5): base is a locked nucleic acid
  modified_base (9)..(9): base is a locked nucleic acid
  modified_base (11)..(11): base is a locked nucleic acid
arrgcyataggkwcagtry

SEQ ID NO: 11888 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (2)..(2): base is a locked nucleic acid
  modified_base (9)..(9): base is a locked nucleic acid
  modified_base (11)..(11): base is a locked nucleic acid
arrgcyataggkwcagtry

SEQ ID NO: 11889 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (7)..(7): base is a locked nucleic acid
  modified_base (9)..(9): base is a locked nucleic acid
  modified_base (11)..(11): base is a locked nucleic acid
arrgcyataggkwcagtry

SEQ ID NO: 11890 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (15)..(15): base is a locked nucleic acid
arrgcyataggkwcagtry

SEQ ID NO: 11891 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (19)..(19): base is a locked nucleic acid
arrgcyataggkwcagtry

SEQ ID NO: 11892 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (14)..(14): base is a locked nucleic acid
arrgcyataggkwcagtry

SEQ ID NO: 11893 - DNA, 19 bp, Artificial Sequence
  Oligonucleotide probe
  misc_binding (1)..(19): Hybridization probe for the specific detection of wild-type HIV-1 at codon 73 of the protease gene.
  modified_base (9)..(9): base is a locked nucleic acid
  modified_base (11)..(11): base is a locked nucleic acid
  modified_base (13)..(13): base is a locked nucleic acid
arrgcyataggkwcagtry

SEQ ID NO: 11894 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (3)..(3): base is a locked nucleic acid
rgcyataggkwcagtry

SEQ ID NO: 11895 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (1)..(1): base is a locked nucleic acid
rgcyataggkwcagtry

SEQ ID NO: 11896 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (4)..(4): base is a locked nucleic acid
rgcyataggkwcagtry

SEQ ID NO: 11897 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (7)..(7): base is a locked nucleic acid
rgcyataggkwcagtry

SEQ ID NO: 11898 - DNA, 17 bp, Artificial Sequence
  Oligonucleotide probe
  misc_binding (1)..(17): Hybridization probe for the specific detection of wild-type HIV-1 at codon 73 of the protease gene.
rgcyataggkwcagtry

SEQ ID NO: 11899 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (10)..(10): base is a locked nucleic acid
rgcyataggkwcagtry

SEQ ID NO: 11900 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (13)..(13): base is a locked nucleic acid
rgcyataggkwcagtry

SEQ ID NO: 11901 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (11)..(11): base is a locked nucleic acid
rgcyataggkwcagtry

SEQ ID NO: 11902 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (7)..(7): base is a locked nucleic acid
  modified_base (8)..(8): base is a locked nucleic acid
  modified_base (10)..(10): base is a locked nucleic acid
rgcyataggkwcagtry

SEQ ID NO: 11903 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (5)..(5): base is a locked nucleic acid
  modified_base (8)..(8): base is a locked nucleic acid
  modified_base (10)..(10): base is a locked nucleic acid
rgcyataggkwcagtry

SEQ ID NO: 11904 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (2)..(2): base is a locked nucleic acid
  modified_base (8)..(8): base is a locked nucleic acid
  modified_base (10)..(10): base is a locked nucleic acid
rgcyataggkwcagtry

SEQ ID NO: 11905 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (3)..(3): base is a locked nucleic acid
  modified_base (8)..(8): base is a locked nucleic acid
  modified_base (10)..(10): base is a locked nucleic acid
rgcyataggkwcagtry

SEQ ID NO: 11906 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (13)..(13): base is a locked nucleic acid
rgcyataggkwcagtry

SEQ ID NO: 11907 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (11)..(11): base is a locked nucleic acid
rgcyataggkwcagtry

SEQ ID NO: 11908 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (17)..(17): base is a locked nucleic acid
rgcyataggkwcagtry

SEQ ID NO: 11909 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (12)..(12): base is a locked nucleic acid
rgcyataggkwcagtry

SEQ ID NO: 11910 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (7)..(7): base is a locked nucleic acid
rrgcyataggkwcagtr

SEQ ID NO: 11911 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (1)..(1): base is a locked nucleic acid
rrgcyataggkwcagtr

SEQ ID NO: 11912 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (2)..(2): base is a locked nucleic acid
rrgcyataggkwcagtr

SEQ ID NO: 11913 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (4)..(4): base is a locked nucleic acid
rrgcyataggkwcagtr

SEQ ID NO: 11914 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (14)..(14): base is a locked nucleic acid
rrgcyataggkwcagtr

SEQ ID NO: 11915 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (12)..(12): base is a locked nucleic acid
rrgcyataggkwcagtr

SEQ ID NO: 11916 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (11)..(11): base is a locked nucleic acid
rrgcyataggkwcagtr

SEQ ID NO: 11917 - DNA, 17 bp, Artificial Sequence
  Oligonucleotide probe
  misc_binding (1)..(17): Hybridization probe for the specific detection of wild-type HIV-1 at codon 73 of the protease gene.
rrgcyataggkwcagtr

SEQ ID NO: 11918 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (7)..(7): base is a locked nucleic acid
  modified_base (8)..(8): base is a locked nucleic acid
  modified_base (10)..(10): base is a locked nucleic acid
rrgcyataggkwcagtr

SEQ ID NO: 11919 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (4)..(4): base is a locked nucleic acid
  modified_base (8)..(8): base is a locked nucleic acid
  modified_base (10)..(10): base is a locked nucleic acid
rrgcyataggkwcagtr

SEQ ID NO: 11920 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (1)..(1): base is a locked nucleic acid
  modified_base (8)..(8): base is a locked nucleic acid
  modified_base (10)..(10): base is a locked nucleic acid
rrgcyataggkwcagtr

SEQ ID NO: 11921 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (6)..(6): base is a locked nucleic acid
  modified_base (8)..(8): base is a locked nucleic acid
  modified_base (10)..(10): base is a locked nucleic acid
rrgcyataggkwcagtr

SEQ ID NO: 11922 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (14)..(14): base is a locked nucleic acid
rrgcyataggkwcagtr

SEQ ID NO: 11923 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
rrgcyataggkwcagtr

SEQ ID NO: 11924 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (13)..(13): base is a locked nucleic acid
rrgcyataggkwcagtr

SEQ ID NO: 11925 - DNA, 17 bp, Artificial Sequence
  Oligonucleotide probe
  misc_binding (1)..(17): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (12)..(12): base is a locked nucleic acid
rrgcyataggkwcagtr

SEQ ID NO: 11926 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (3)..(3): base is a locked nucleic acid
rgcyataggkwcagt

SEQ ID NO: 11927 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (1)..(1): base is a locked nucleic acid
rgcyataggkwcagt

SEQ ID NO: 11928 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (4)..(4): base is a locked nucleic acid
rgcyataggkwcagt

SEQ ID NO: 11929 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (7)..(7): base is a locked nucleic acid
rgcyataggkwcagt

SEQ ID NO: 11930 - DNA, 16 bp, Artificial Sequence
  Oligonucleotide probe
  misc_binding (1)..(16): Hybridization probe for the specific detection of wild-type HIV-1 at codon 73 of the protease gene.
rgcyataggkwcagtr

SEQ ID NO: 11931 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (10)..(10): base is a locked nucleic acid
rgcyataggkwcagt

SEQ ID NO: 11932 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (13)..(13): base is a locked nucleic acid
rgcyataggkwcagt

SEQ ID NO: 11933 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (11)..(11): base is a locked nucleic acid
rgcyataggkwcagt

SEQ ID NO: 11934 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (7)..(7): base is a locked nucleic acid
  modified_base (8)..(8): base is a locked nucleic acid
  modified_base (10)..(10): base is a locked nucleic acid
rgcyataggkwcagt

SEQ ID NO: 11935 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (5)..(5): base is a locked nucleic acid
  modified_base (8)..(8): base is a locked nucleic acid
  modified_base (10)..(10): base is a locked nucleic acid
rgcyataggkwcagt

SEQ ID NO: 11936 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (2)..(2): base is a locked nucleic acid
  modified_base (8)..(8): base is a locked nucleic acid
  modified_base (10)..(10): base is a locked nucleic acid
rgcyataggkwcagt

SEQ ID NO: 11937 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (3)..(3): base is a locked nucleic acid
  modified_base (8)..(8): base is a locked nucleic acid
  modified_base (10)..(10): base is a locked nucleic acid
rgcyataggkwcagt

SEQ ID NO: 11938 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (13)..(13): base is a locked nucleic acid
rgcyataggkwcagt

SEQ ID NO: 11939 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (11)..(11): base is a locked nucleic acid
rgcyataggkwcagt

SEQ ID NO: 11940 - DNA, 16 bp, Artificial Sequence
  Oligonucleotide probe
  misc_binding (1)..(16): Hybridization probe for the specific detection of wild-type HIV-1 at codon 73 of the protease gene.
  modified_base (8)..(8): base is a locked nucleic acid
  modified_base (10)..(10): base is a locked nucleic acid
rgcyataggkwcagtr

SEQ ID NO: 11941 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (12)..(12): base is a locked nucleic acid
rgcyataggkwcagt

SEQ ID NO: 11942 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (7)..(7): base is a locked nucleic acid
rrgcyataggkwcag

SEQ ID NO: 11943 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (1)..(1): base is a locked nucleic acid
rrgcyataggkwcag

SEQ ID NO: 11944 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (2)..(2): base is a locked nucleic acid
rrgcyataggkwcag

SEQ ID NO: 11945 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (4)..(4): base is a locked nucleic acid
rrgcyataggkwcag

SEQ ID NO: 11946 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (14)..(14): base is a locked nucleic acid
rrgcyataggkwcag

SEQ ID NO: 11947 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (12)..(12): base is a locked nucleic acid
rrgcyataggkwcag

SEQ ID NO: 11948 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (11)..(11): base is a locked nucleic acid
rrgcyataggkwcag

SEQ ID NO: 11949 - DNA, 16 bp, Artificial Sequence
  Oligonucleotide probe
  misc_binding (1)..(16): Hybridization probe for the specific detection of wild-type HIV-1 at codon 73 of the protease gene.
rrgcyataggkwcagt

SEQ ID NO: 11950 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (7)..(7): base is a locked nucleic acid
  modified_base (8)..(8): base is a locked nucleic acid
  modified_base (10)..(10): base is a locked nucleic acid
rrgcyataggkwcag

SEQ ID NO: 11951 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (4)..(4): base is a locked nucleic acid
  modified_base (8)..(8): base is a locked nucleic acid
  modified_base (10)..(10): base is a locked nucleic acid
rrgcyataggkwcag

SEQ ID NO: 11952 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (1)..(1): base is a locked nucleic acid
  modified_base (8)..(8): base is a locked nucleic acid
  modified_base (10)..(10): base is a locked nucleic acid
rrgcyataggkwcag

SEQ ID NO: 11953 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (6)..(6): base is a locked nucleic acid
  modified_base (8)..(8): base is a locked nucleic acid
  modified_base (10)..(10): base is a locked nucleic acid
rrgcyataggkwcag

SEQ ID NO: 11954 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (14)..(14): base is a locked nucleic acid
rrgcyataggkwcag

SEQ ID NO: 11955 - DNA, 16 bp, Artificial Sequence
  Oligonucleotide probe
  misc_binding (1)..(16): Hybridization probe for the specific detection of wild-type HIV-1 at codon 73 of the protease gene.
  modified_base (8)..(8): base is a locked nucleic acid
  modified_base (10)..(10): base is a locked nucleic acid
rrgcyataggkwcagt

SEQ ID NO: 11956 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (13)..(13): base is a locked nucleic acid
rrgcyataggkwcag

SEQ ID NO: 11957 - DNA, 15 bp, Artificial Sequence
  Oligonucleotide probe
  misc_binding (1)..(15): Hybridization probe for the specific detection of wild-type HIV-1 at codon 73 of the protease gene.
  modified_base (8)..(8): base is a locked nucleic acid
  modified_base (10)..(10): base is a locked nucleic acid
  modified_base (12)..(12): base is a locked nucleic acid
rrgcyataggkwcag

SEQ ID NO: 11958 - DNA, 15 bp, Artificial Sequence
  Oligonucleotide probe
  misc_binding (1)..(15): Hybridization probe for the specific detection of wild-type HIV-1 at codon 73 of the protease gene.
  misc_feature (7)..(7): n is a, c, g, or t
tactgtncctatagc

SEQ ID NO: 11959 - DNA, 20 bp, Artificial Sequence
  Oligonucleotide probe
  misc_binding (1)..(20): Hybridization probe for the specific detection of wild-type HIV-1 at codon 73 of the protease gene.
rrgcyataggkwcagtrytr

SEQ ID NO: 11960 - DNA, 20 bp, Artificial Sequence
  Oligonucleotide probe
  misc_binding (1)..(20): Hybridization probe for the specific detection of wild-type HIV-1 at codon 73 of the protease gene.
arrgcyataggkwcagtryt

SEQ ID NO: 11961 - DNA, 19 bp, Artificial Sequence
  Oligonucleotide probe
  misc_binding (1)..(19): Hybridization probe for the specific detection of wild-type HIV-1 at codon 73 of the protease gene.
rrgcyataggkwcagtryt

SEQ ID NO: 11962 - DNA, 19 bp, Artificial Sequence
  Oligonucleotide probe
  misc_binding (1)..(19): Hybridization probe for the specific detection of wild-type HIV-1 at codon 73 of the protease gene.
arrgcyataggkwcagtry

SEQ ID NO: 11963 - DNA, 17 bp, Artificial Sequence
  Oligonucleotide probe
  misc_binding (1)..(17): Hybridization probe for the specific detection of wild-type HIV-1 at codon 73 of the protease gene.
rgcyataggkwcagtry

SEQ ID NO: 11964 - DNA, 17 bp, Artificial Sequence
  Oligonucleotide probe
  misc_binding (1)..(17): Hybridization probe for the specific detection of wild-type HIV-1 at codon 73 of the protease gene.
rrgcyataggkwcagtr

SEQ ID NO: 11965 - DNA, 15 bp, Artificial Sequence
  Oligonucleotide probe
  misc_binding (1)..(15): Hybridization probe for the specific detection of wild-type HIV-1 at codon 73 of the protease gene.
rgcyataggkwcagt

SEQ ID NO: 11966 - DNA, 15 bp, Artificial Sequence
  Oligonucleotide probe
  misc_binding (1)..(15): Hybridization probe for the specific detection of wild-type HIV-1 at codon 73 of the protease gene.
rrgcyataggkwcag

SEQ ID NO: 11967 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (8)..(8): base is a locked nucleic acid
gcyataggkacagtrytrrt

SEQ ID NO: 11968 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (4)..(4): base is a locked nucleic acid
gcyataggkacagtrytrrt

SEQ ID NO: 11969 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (3)..(3): base is a locked nucleic acid
gcyataggkacagtrytrrt

SEQ ID NO: 11970 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (9)..(9): base is a locked nucleic acid
gcyataggkacagtrytrrt

SEQ ID NO: 11971 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (13)..(13): base is a locked nucleic acid
gcyataggkacagtrytrrt

SEQ ID NO: 11972 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (19)..(19): base is a locked nucleic acid
gcyataggkacagtrytrrt

SEQ ID NO: 11973 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (11)..(11): base is a locked nucleic acid
gcyataggkacagtrytrrt

SEQ ID NO: 11974 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (18)..(18): base is a locked nucleic acid
gcyataggkacagtrytrrt

SEQ ID NO: 11975 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (3)..(3): base is a locked nucleic acid
  modified_base (9)..(9): base is a locked nucleic acid
  modified_base (11)..(11): base is a locked nucleic acid
gcyataggkacagtrytrrt

SEQ ID NO: 11976 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (7)..(7): base is a locked nucleic acid
  modified_base (9)..(9): base is a locked nucleic acid
  modified_base (11)..(11): base is a locked nucleic acid
gcyataggkacagtrytrrt

SEQ ID NO: 11977 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (4)..(4): base is a locked nucleic acid
  modified_base (9)..(9): base is a locked nucleic acid
  modified_base (11)..(11): base is a locked nucleic acid
gcyataggkacagtrytrrt

SEQ ID NO: 11978 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (5)..(5): base is a locked nucleic acid
  modified_base (9)..(9): base is a locked nucleic acid
  modified_base (11)..(11): base is a locked nucleic acid
gcyataggkacagtrytrrt

SEQ ID NO: 11979 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (19)..(19): base is a locked nucleic acid
gcyataggkacagtrytrrt

SEQ ID NO: 11980 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (14)..(14): base is a locked nucleic acid
gcyataggkacagtrytrrt

SEQ ID NO: 11981 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (15)..(15): base is a locked nucleic acid
gcyataggkacagtrytrrt

SEQ ID NO: 11982 - DNA, 20 bp, Artificial Sequence
  Oligonucleotide probe
  misc_binding (1)..(20): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (12)..(12): base is a locked nucleic acid
gcyataggkacagtrytrrt

SEQ ID NO: 11983 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (8)..(8): base is a locked nucleic acid
gcyataggkacagtrytrr

SEQ ID NO: 11984 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (4)..(4): base is a locked nucleic acid
gcyataggkacagtrytrr

SEQ ID NO: 11985 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (3)..(3): base is a locked nucleic acid
gcyataggkacagtrytrr

SEQ ID NO: 11986 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (9)..(9): base is a locked nucleic acid
gcyataggkacagtrytrr

SEQ ID NO: 11987 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (13)..(13): base is a locked nucleic acid
gcyataggkacagtrytrr

SEQ ID NO: 11988 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (19)..(19): base is a locked nucleic acid
gcyataggkacagtrytrr

SEQ ID NO: 11989 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (11)..(11): base is a locked nucleic acid
gcyataggkacagtrytrr

SEQ ID NO: 11990 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (18)..(18): base is a locked nucleic acid
gcyataggkacagtrytrr

SEQ ID NO: 11991 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (3)..(3): base is a locked nucleic acid
  modified_base (9)..(9): base is a locked nucleic acid
  modified_base (11)..(11): base is a locked nucleic acid
gcyataggkacagtrytrr

SEQ ID NO: 11992 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (7)..(7): base is a locked nucleic acid
  modified_base (9)..(9): base is a locked nucleic acid
  modified_base (11)..(11): base is a locked nucleic acid
gcyataggkacagtrytrr

SEQ ID NO: 11993 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (4)..(4): base is a locked nucleic acid
  modified_base (9)..(9): base is a locked nucleic acid
  modified_base (11)..(11): base is a locked nucleic acid
gcyataggkacagtrytrr

SEQ ID NO: 11994 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (5)..(5): base is a locked nucleic acid
  modified_base (9)..(9): base is a locked nucleic acid
  modified_base (11)..(11): base is a locked nucleic acid
gcyataggkacagtrytrr

SEQ ID NO: 11995 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (19)..(19): base is a locked nucleic acid
gcyataggkacagtrytrr

SEQ ID NO: 11996 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (14)..(14): base is a locked nucleic acid
gcyataggkacagtrytrr

SEQ ID NO: 11997 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (15)..(15): base is a locked nucleic acid
gcyataggkacagtrytrr

SEQ ID NO: 11998 - DNA, 19 bp, Artificial Sequence
  Oligonucleotide probe
  misc_binding (1)..(19): Hybridization probe for the specific detection of wild-type HIV-1 at codon 74 of the protease gene.
  modified_base (9)..(9): base is a locked nucleic acid
  modified_base (11)..(11): base is a locked nucleic acid
  modified_base (12)..(12): base is a locked nucleic acid
gcyataggkacagtrytrr

SEQ ID NO: 11999 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (7)..(7): base is a locked nucleic acid
cyataggkacagtrytr

SEQ ID NO: 12000 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (3)..(3): base is a locked nucleic acid
cyataggkacagtrytr

SEQ ID NO: 12001 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (2)..(2): base is a locked nucleic acid
cyataggkacagtrytr

SEQ ID NO: 12002 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (8)..(8): base is a locked nucleic acid
cyataggkacagtrytr

SEQ ID NO: 12003 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (12)..(12): base is a locked nucleic acid
cyataggkacagtrytr

SEQ ID NO: 12004 - DNA, 17 bp, Artificial Sequence
  Oligonucleotide probe
  misc_binding (1)..(17): Hybridization probe for the specific detection of wild-type HIV-1 at codon 74 of the protease gene.
cyataggkacagtrytr

SEQ ID NO: 12005 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (10)..(10): base is a locked nucleic acid
cyataggkacagtrytr

SEQ ID NO: 12006 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (17)..(17): base is a locked nucleic acid
cyataggkacagtrytr

SEQ ID NO: 12007 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (2)..(2): base is a locked nucleic acid
  modified_base (8)..(8): base is a locked nucleic acid
  modified_base (10)..(10): base is a locked nucleic acid
cyataggkacagtrytr

SEQ ID NO: 12008 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (6)..(6): base is a locked nucleic acid
  modified_base (8)..(8): base is a locked nucleic acid
  modified_base (10)..(10): base is a locked nucleic acid
cyataggkacagtrytr

SEQ ID NO: 12009 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (3)..(3): base is a locked nucleic acid
  modified_base (8)..(8): base is a locked nucleic acid
  modified_base (10)..(10): base is a locked nucleic acid
cyataggkacagtrytr

SEQ ID NO: 12010 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (4)..(4): base is a locked nucleic acid
  modified_base (8)..(8): base is a locked nucleic acid
  modified_base (10)..(10): base is a locked nucleic acid
cyataggkacagtrytr

SEQ ID NO: 12011 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (8)..(8): base is a locked nucleic acid
  modified_base (10)..(10): base is a locked nucleic acid
cyataggkacagtrytr

SEQ ID NO: 12012 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (8)..(8): base is a locked nucleic acid
  modified_base (10)..(10): base is a locked nucleic acid
  modified_base (13)..(13): base is a locked nucleic acid
cyataggkacagtrytr

SEQ ID NO: 12013 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (8)..(8): base is a locked nucleic acid
  modified_base (10)..(10): base is a locked nucleic acid
  modified_base (14)..(14): base is a locked nucleic acid
cyataggkacagtrytr

SEQ ID NO: 12014 - DNA, 17 bp, Artificial Sequence
  Oligonucleotide probe
  misc_binding (1)..(17): Hybridization probe for the specific detection of wild-type HIV-1 at codon 74 of the protease gene.
  modified_base (8)..(8): base is a locked nucleic acid
  modified_base (10)..(10): base is a locked nucleic acid
  modified_base (11)..(11): base is a locked nucleic acid
cyataggkacagtrytr

SEQ ID NO: 12015 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (7)..(7): base is a locked nucleic acid
cyataggkacagtry

SEQ ID NO: 12016 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (3)..(3): base is a locked nucleic acid
cyataggkacagtry

SEQ ID NO: 12017 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (2)..(2): base is a locked nucleic acid
cyataggkacagtry

SEQ ID NO: 12018 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (8)..(8): base is a locked nucleic acid
cyataggkacagtry

SEQ ID NO: 12019 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (12)..(12): base is a locked nucleic acid
cyataggkacagtry

SEQ ID NO: 12020 - DNA, 16 bp, Artificial Sequence
  Oligonucleotide probe
  misc_binding (1)..(16): Hybridization probe for the specific detection of wild-type HIV-1 at codon 74 of the protease gene.
cyataggkacagtryt

SEQ ID NO: 12021 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (10)..(10): base is a locked nucleic acid
cyataggkacagtry

SEQ ID NO: 12022 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (2)..(2): base is a locked nucleic acid
  modified_base (8)..(8): base is a locked nucleic acid
  modified_base (10)..(10): base is a locked nucleic acid
cyataggkacagtry

SEQ ID NO: 12023 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (6)..(6): base is a locked nucleic acid
  modified_base (8)..(8): base is a locked nucleic acid
  modified_base (10)..(10): base is a locked nucleic acid
cyataggkacagtry

SEQ ID NO: 12024 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (3)..(3): base is a locked nucleic acid
  modified_base (8)..(8): base is a locked nucleic acid
  modified_base (10)..(10): base is a locked nucleic acid
cyataggkacagtry

SEQ ID NO: 12025 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (4)..(4): base is a locked nucleic acid
  modified_base (8)..(8): base is a locked nucleic acid
  modified_base (10)..(10): base is a locked nucleic acid
cyataggkacagtry

SEQ ID NO: 12026 - DNA, 16 bp, Artificial Sequence
  Oligonucleotide probe
  misc_binding (1)..(16): Hybridization probe for the specific detection of wild-type HIV-1 at codon 74 of the protease gene.
  modified_base (8)..(8): base is a locked nucleic acid
  modified_base (10)..(10): base is a locked nucleic acid
cyataggkacagtryt

SEQ ID NO: 12027 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (8)..(8): base is a locked nucleic acid
  modified_base (10)..(10): base is a locked nucleic acid
  modified_base (13)..(13): base is a locked nucleic acid
cyataggkacagtry

SEQ ID NO: 12028 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (8)..(8): base is a locked nucleic acid
  modified_base (10)..(10): base is a locked nucleic acid
  modified_base (14)..(14): base is a locked nucleic acid
cyataggkacagtry

SEQ ID NO: 12029 - DNA, 15 bp, Artificial Sequence
  Oligonucleotide probe
  misc_binding (1)..(15): Hybridization probe for the specific detection of wild-type HIV-1 at codon 74 of the protease gene.
  modified_base (8)..(8): base is a locked nucleic acid
  modified_base (10)..(10): base is a locked nucleic acid
  modified_base (11)..(11): base is a locked nucleic acid
cyataggkacagtry

SEQ ID NO: 12030 - DNA, 15 bp, Artificial Sequence
  Oligonucleotide probe
  misc_binding (1)..(15): Hybridization probe for the specific detection of wild-type HIV-1 at codon 74 of the protease gene.
ataggtacrgtatta

SEQ ID NO: 12031 - DNA, 20 bp, Artificial Sequence
  Oligonucleotide probe
  misc_binding (1)..(20): Hybridization probe for the specific detection of wild-type HIV-1 at codon 74 of the protease gene.
gcyataggkacagtrytrrt

SEQ ID NO: 12032 - DNA, 19 bp, Artificial Sequence
  Oligonucleotide probe
  misc_binding (1)..(19): Hybridization probe for the specific detection of wild-type HIV-1 at codon 74 of the protease gene.
gcyataggkacagtrytrr

SEQ ID NO: 12033 - DNA, 17 bp, Artificial Sequence
  Oligonucleotide probe
  misc_binding (1)..(17): Hybridization probe for the specific detection of wild-type HIV-1 at codon 74 of the protease gene.
cyataggkacagtrytr

SEQ ID NO: 12034 - DNA, 15 bp, Artificial Sequence
  Oligonucleotide probe
  misc_binding (1)..(15): Hybridization probe for the specific detection of wild-type HIV-1 at codon 74 of the protease gene.
cyataggkacagtry

SEQ ID NO: 12035 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (7)..(7): base is a locked nucleic acid
ggkwcagtrytrrtrggrcc

SEQ ID NO: 12036 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (4)..(4): base is a locked nucleic acid
ggkwcagtrytrrtrggrcc

SEQ ID NO: 12037 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (9)..(9): base is a locked nucleic acid
ggkwcagtrytrrtrggrcc

SEQ ID NO: 12038 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (2)..(2): base is a locked nucleic acid
ggkwcagtrytrrtrggrcc

SEQ ID NO: 12039 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (19)..(19): base is a locked nucleic acid
ggkwcagtrytrrtrggrcc

SEQ ID NO: 12040 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (15)..(15): base is a locked nucleic acid
ggkwcagtrytrrtrggrcc

SEQ ID NO: 12041 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (13)..(13): base is a locked nucleic acid
ggkwcagtrytrrtrggrcc

SEQ ID NO: 12042 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (11)..(11): base is a locked nucleic acid
ggkwcagtrytrrtrggrcc

SEQ ID NO: 12043 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (5)..(5): base is a locked nucleic acid
  modified_base (9)..(9): base is a locked nucleic acid
  modified_base (11)..(11): base is a locked nucleic acid
ggkwcagtrytrrtrggrcc

SEQ ID NO: 12044 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (3)..(3): base is a locked nucleic acid
  modified_base (9)..(9): base is a locked nucleic acid
  modified_base (11)..(11): base is a locked nucleic acid
ggkwcagtrytrrtrggrcc

SEQ ID NO: 12045 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (6)..(6): base is a locked nucleic acid
  modified_base (9)..(9): base is a locked nucleic acid
  modified_base (11)..(11): base is a locked nucleic acid
ggkwcagtrytrrtrggrcc

SEQ ID NO: 12046 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (2)..(2): base is a locked nucleic acid
  modified_base (9)..(9): base is a locked nucleic acid
  modified_base (11)..(11): base is a locked nucleic acid
ggkwcagtrytrrtrggrcc

SEQ ID NO: 12047 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (12)..(12): base is a locked nucleic acid
ggkwcagtrytrrtrggrcc

SEQ ID NO: 12048 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (14)..(14): base is a locked nucleic acid
ggkwcagtrytrrtrggrcc

SEQ ID NO: 12049 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (15)..(15): base is a locked nucleic acid
ggkwcagtrytrrtrggrcc

SEQ ID NO: 12050 - DNA, 20 bp, Artificial Sequence
  Oligonucleotide probe
  misc_binding (1)..(20): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (16)..(16): base is a locked nucleic acid
ggkwcagtrytrrtrggrcc

SEQ ID NO: 12051 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (7)..(7): base is a locked nucleic acid
ggkwcagtrytrrtrggrc

SEQ ID NO: 12052 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (4)..(4): base is a locked nucleic acid
ggkwcagtrytrrtrggrc

SEQ ID NO: 12053 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (9)..(9): base is a locked nucleic acid
ggkwcagtrytrrtrggrc

SEQ ID NO: 12054 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (2)..(2): base is a locked nucleic acid
ggkwcagtrytrrtrggrc

SEQ ID NO: 12055 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (19)..(19): base is a locked nucleic acid
ggkwcagtrytrrtrggrc

SEQ ID NO: 12056 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (15)..(15): base is a locked nucleic acid
ggkwcagtrytrrtrggrc

SEQ ID NO: 12057 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (13)..(13): base is a locked nucleic acid
ggkwcagtrytrrtrggrc

SEQ ID NO: 12058 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (11)..(11): base is a locked nucleic acid
ggkwcagtrytrrtrggrc

SEQ ID NO: 12059 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (5)..(5): base is a locked nucleic acid
  modified_base (9)..(9): base is a locked nucleic acid
  modified_base (11)..(11): base is a locked nucleic acid
ggkwcagtrytrrtrggrc

SEQ ID NO: 12060 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (3)..(3): base is a locked nucleic acid
  modified_base (9)..(9): base is a locked nucleic acid
  modified_base (11)..(11): base is a locked nucleic acid
ggkwcagtrytrrtrggrc

SEQ ID NO: 12061 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (6)..(6): base is a locked nucleic acid
  modified_base (9)..(9): base is a locked nucleic acid
  modified_base (11)..(11): base is a locked nucleic acid
ggkwcagtrytrrtrggrc

SEQ ID NO: 12062 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (2)..(2): base is a locked nucleic acid
  modified_base (9)..(9): base is a locked nucleic acid
  modified_base (11)..(11): base is a locked nucleic acid
ggkwcagtrytrrtrggrc

SEQ ID NO: 12063 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (12)..(12): base is a locked nucleic acid
ggkwcagtrytrrtrggrc

SEQ ID NO: 12064 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (14)..(14): base is a locked nucleic acid
ggkwcagtrytrrtrggrc

SEQ ID NO: 12065 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (15)..(15): base is a locked nucleic acid
ggkwcagtrytrrtrggrc

SEQ ID NO: 12066 - DNA, 19 bp, Artificial Sequence
  Oligonucleotide probe
  misc_binding (1)..(19): Hybridization probe for the specific detection of wild-type HIV-1 at codon 76 of the protease gene.
  modified_base (9)..(9): base is a locked nucleic acid
  modified_base (11)..(11): base is a locked nucleic acid
  modified_base (16)..(16): base is a locked nucleic acid
ggkwcagtrytrrtrggrc

SEQ ID NO: 12067 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (6)..(6): base is a locked nucleic acid
gkwcagtrytrrtrggr

SEQ ID NO: 12068 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (3)..(3): base is a locked nucleic acid
gkwcagtrytrrtrggr

SEQ ID NO: 12069 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (8)..(8): base is a locked nucleic acid
gkwcagtrytrrtrggr

SEQ ID NO: 12070 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (1)..(1): base is a locked nucleic acid
gkwcagtrytrrtrggr

SEQ ID NO: 12071 - DNA, 17 bp, Artificial Sequence
  Oligonucleotide probe
  misc_binding (1)..(17): Hybridization probe for the specific detection of wild-type HIV-1 at codon 76 of the protease gene.
gkwcagtrytrrtrggr

SEQ ID NO: 12072 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (14)..(14): base is a locked nucleic acid
gkwcagtrytrrtrggr

SEQ ID NO: 12073 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (12)..(12): base is a locked nucleic acid
gkwcagtrytrrtrggr

SEQ ID NO: 12074 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (10)..(10): base is a locked nucleic acid
gkwcagtrytrrtrggr

SEQ ID NO: 12075 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (4)..(4): base is a locked nucleic acid
  modified_base (8)..(8): base is a locked nucleic acid
  modified_base (10)..(10): base is a locked nucleic acid
gkwcagtrytrrtrggr

SEQ ID NO: 12076 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (2)..(2): base is a locked nucleic acid
  modified_base (8)..(8): base is a locked nucleic acid
  modified_base (10)..(10): base is a locked nucleic acid
gkwcagtrytrrtrggr

SEQ ID NO: 12077 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (5)..(5): base is a locked nucleic acid
  modified_base (8)..(8): base is a locked nucleic acid
  modified_base (10)..(10): base is a locked nucleic acid
gkwcagtrytrrtrggr

SEQ ID NO: 12078 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (1)..(1): base is a locked nucleic acid
  modified_base (8)..(8): base is a locked nucleic acid
  modified_base (10)..(10): base is a locked nucleic acid
gkwcagtrytrrtrggr

SEQ ID NO: 12079 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (11)..(11): base is a locked nucleic acid
gkwcagtrytrrtrggr

SEQ ID NO: 12080 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (13)..(13): base is a locked nucleic acid
gkwcagtrytrrtrggr

SEQ ID NO: 12081 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (14)..(14): base is a locked nucleic acid
gkwcagtrytrrtrggr

SEQ ID NO: 12082 - DNA, 17 bp, Artificial Sequence
  Oligonucleotide probe
  misc_binding (1)..(17): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (15)..(15): base is a locked nucleic acid
gkwcagtrytrrtrggr

SEQ ID NO: 12083 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (6)..(6): base is a locked nucleic acid
gkwcagtrytrrtrg

SEQ ID NO: 12084 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (3)..(3): base is a locked nucleic acid
gkwcagtrytrrtrg

SEQ ID NO: 12085 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (8)..(8): base is a locked nucleic acid
gkwcagtrytrrtrg

SEQ ID NO: 12086 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (1)..(1): base is a locked nucleic acid
gkwcagtrytrrtrg

SEQ ID NO: 12087 - DNA, 16 bp, Artificial Sequence
  Oligonucleotide probe
  misc_binding (1)..(16): Hybridization probe for the specific detection of wild-type HIV-1 at codon 76 of the protease gene.
gkwcagtrytrrtrgg

SEQ ID NO: 12088 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (14)..(14): base is a locked nucleic acid
gkwcagtrytrrtrg

SEQ ID NO: 12089 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (12)..(12): base is a locked nucleic acid
gkwcagtrytrrtrg

SEQ ID NO: 12090 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (10)..(10): base is a locked nucleic acid
gkwcagtrytrrtrg

SEQ ID NO: 12091 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (4)..(4): base is a locked nucleic acid
  modified_base (8)..(8): base is a locked nucleic acid
  modified_base (10)..(10): base is a locked nucleic acid
gkwcagtrytrrtrg

SEQ ID NO: 12092 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (2)..(2): base is a locked nucleic acid
  modified_base (8)..(8): base is a locked nucleic acid
  modified_base (10)..(10): base is a locked nucleic acid
gkwcagtrytrrtrg

SEQ ID NO: 12093 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (5)..(5): base is a locked nucleic acid
  modified_base (8)..(8): base is a locked nucleic acid
  modified_base (10)..(10): base is a locked nucleic acid
gkwcagtrytrrtrg

SEQ ID NO: 12094 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (1)..(1): base is a locked nucleic acid
  modified_base (8)..(8): base is a locked nucleic acid
  modified_base (10)..(10): base is a locked nucleic acid
gkwcagtrytrrtrg

SEQ ID NO: 12095 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (11)..(11): base is a locked nucleic acid
gkwcagtrytrrtrg

SEQ ID NO: 12096 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (13)..(13): base is a locked nucleic acid
gkwcagtrytrrtrg

SEQ ID NO: 12097 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (14)..(14): base is a locked nucleic acid
gkwcagtrytrrtrg

SEQ ID NO: 12098 - DNA, 15 bp, Artificial Sequence
  Oligonucleotide probe
  misc_binding (1)..(15): Hybridization probe for the specific detection of wild-type HIV-1 at codon 76 of the protease gene.
  modified_base (8)..(8): base is a locked nucleic acid
  modified_base (10)..(10): base is a locked nucleic acid
  modified_base (15)..(15): base is a locked nucleic acid
gkwcagtrytrrtrg

SEQ ID NO: 12099 - DNA, 15 bp, Artificial Sequence
  Oligonucleotide probe
  misc_binding (1)..(15): Hybridization probe for the specific detection of wild-type HIV-1 at codon 76 of the protease gene.
acagtaytrgtagga

SEQ ID NO: 12100 - DNA, 20 bp, Artificial Sequence
  Oligonucleotide probe
  misc_binding (1)..(20): Hybridization probe for the specific detection of wild-type HIV-1 at codon 76 of the protease gene.
ggkwcagtrytrrtrggrcc

SEQ ID NO: 12101 - DNA, 19 bp, Artificial Sequence
  Oligonucleotide probe
  misc_binding (1)..(19): Hybridization probe for the specific detection of wild-type HIV-1 at codon 76 of the protease gene.
ggkwcagtrytrrtrggrc

SEQ ID NO: 12102 - DNA, 17 bp, Artificial Sequence
  Oligonucleotide probe
  misc_binding (1)..(17): Hybridization probe for the specific detection of wild-type HIV-1 at codon 76 of the protease gene.
gkwcagtrytrrtrggr

SEQ ID NO: 12103 - DNA, 15 bp, Artificial Sequence
  Oligonucleotide probe
  misc_binding (1)..(15): Hybridization probe for the specific detection of wild-type HIV-1 at codon 76 of the protease gene.
gkwcagtrytrrtrg

SEQ ID NO: 12104 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (6)..(6): base is a locked nucleic acid
cyacacctrtcaacataatt

SEQ ID NO: 12105 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (4)..(4): base is a locked nucleic acid
cyacacctrtcaacataatt

SEQ ID NO: 12106 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (7)..(7): base is a locked nucleic acid
cyacacctrtcaacataatt

SEQ ID NO: 12107 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
cyacacctrtcaacataatt

SEQ ID NO: 12108 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (17)..(17): base is a locked nucleic acid
cyacacctrtcaacataatt

SEQ ID NO: 12109 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (16)..(16): base is a locked nucleic acid
cyacacctrtcaacataatt

SEQ ID NO: 12110 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (19)..(19): base is a locked nucleic acid
cyacacctrtcaacataatt

SEQ ID NO: 12111 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (13)..(13): base is a locked nucleic acid
cyacacctrtcaacataatt

SEQ ID NO: 12112 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (5)..(5): base is a locked nucleic acid
  modified_base (9)..(9): base is a locked nucleic acid
  modified_base (11)..(11): base is a locked nucleic acid
cyacacctrtcaacataatt

SEQ ID NO: 12113 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (4)..(4): base is a locked nucleic acid
  modified_base (9)..(9): base is a locked nucleic acid
  modified_base (11)..(11): base is a locked nucleic acid
cyacacctrtcaacataatt

SEQ ID NO: 12114 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (8)..(8): base is a locked nucleic acid
  modified_base (9)..(9): base is a locked nucleic acid
  modified_base (11)..(11): base is a locked nucleic acid
cyacacctrtcaacataatt

SEQ ID NO: 12115 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (2)..(2): base is a locked nucleic acid
  modified_base (9)..(9): base is a locked nucleic acid
  modified_base (11)..(11): base is a locked nucleic acid
cyacacctrtcaacataatt

SEQ ID NO: 12116 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (15)..(15): base is a locked nucleic acid
cyacacctrtcaacataatt

SEQ ID NO: 12117 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (19)..(19): base is a locked nucleic acid
cyacacctrtcaacataatt

SEQ ID NO: 12118 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (16)..(16): base is a locked nucleic acid
cyacacctrtcaacataatt

SEQ ID NO: 12119 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (14)..(14): base is a locked nucleic acid
cyacacctrtcaacataatt

SEQ ID NO: 12120 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (5)..(5): base is a locked nucleic acid
ccyacacctgtcaacataat

SEQ ID NO: 12121 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
ccyacacctgtcaacataat

SEQ ID NO: 12122 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (3)..(3): base is a locked nucleic acid
ccyacacctgtcaacataat

SEQ ID NO: 12123 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (8)..(8): base is a locked nucleic acid
ccyacacctgtcaacataat

SEQ ID NO: 12124 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (15)..(15): base is a locked nucleic acid
ccyacacctgtcaacataat

SEQ ID NO: 12125 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (16)..(16): base is a locked nucleic acid
ccyacacctgtcaacataat

SEQ ID NO: 12126 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (17)..(17): base is a locked nucleic acid
ccyacacctgtcaacataat

SEQ ID NO: 12127 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (13)..(13): base is a locked nucleic acid
ccyacacctgtcaacataat

SEQ ID NO: 12128 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (4)..(4): base is a locked nucleic acid
  modified_base (9)..(9): base is a locked nucleic acid
  modified_base (11)..(11): base is a locked nucleic acid
ccyacacctgtcaacataat

SEQ ID NO: 12129 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (3)..(3): base is a locked nucleic acid
  modified_base (9)..(9): base is a locked nucleic acid
  modified_base (11)..(11): base is a locked nucleic acid
ccyacacctgtcaacataat

SEQ ID NO: 12130 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (2)..(2): base is a locked nucleic acid
  modified_base (9)..(9): base is a locked nucleic acid
  modified_base (11)..(11): base is a locked nucleic acid
ccyacacctgtcaacataat

SEQ ID NO: 12131 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (8)..(8): base is a locked nucleic acid
  modified_base (9)..(9): base is a locked nucleic acid
  modified_base (11)..(11): base is a locked nucleic acid
ccyacacctgtcaacataat

SEQ ID NO: 12132 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (13)..(13): base is a locked nucleic acid
ccyacacctgtcaacataat

SEQ ID NO: 12133 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (16)..(16): base is a locked nucleic acid
ccyacacctgtcaacataat

SEQ ID NO: 12134 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (14)..(14): base is a locked nucleic acid
ccyacacctgtcaacataat

SEQ ID NO: 12135 - DNA, 20 bp, Artificial Sequence
  Oligonucleotide probe
  misc_binding (1)..(20): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (18)..(18): base is a locked nucleic acid
ccyacacctgtcaacataat

SEQ ID NO: 12136 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (6)..(6): base is a locked nucleic acid
cyacacctrtcaacataat

SEQ ID NO: 12137 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (4)..(4): base is a locked nucleic acid
cyacacctrtcaacataat

SEQ ID NO: 12138 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (7)..(7): base is a locked nucleic acid
cyacacctrtcaacataat

SEQ ID NO: 12139 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
cyacacctrtcaacataat

SEQ ID NO: 12140 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (17)..(17): base is a locked nucleic acid
cyacacctrtcaacataat

SEQ ID NO: 12141 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (16)..(16): base is a locked nucleic acid
cyacacctrtcaacataat

SEQ ID NO: 12142 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (19)..(19): base is a locked nucleic acid
cyacacctrtcaacataat

SEQ ID NO: 12143 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (13)..(13): base is a locked nucleic acid
cyacacctrtcaacataat

SEQ ID NO: 12144 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (5)..(5): base is a locked nucleic acid
  modified_base (9)..(9): base is a locked nucleic acid
  modified_base (11)..(11): base is a locked nucleic acid
cyacacctrtcaacataat

SEQ ID NO: 12145 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (4)..(4): base is a locked nucleic acid
  modified_base (9)..(9): base is a locked nucleic acid
  modified_base (11)..(11): base is a locked nucleic acid
cyacacctrtcaacataat

SEQ ID NO: 12146 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (8)..(8): base is a locked nucleic acid
  modified_base (9)..(9): base is a locked nucleic acid
  modified_base (11)..(11): base is a locked nucleic acid
cyacacctrtcaacataat

SEQ ID NO: 12147 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (2)..(2): base is a locked nucleic acid
  modified_base (9)..(9): base is a locked nucleic acid
  modified_base (11)..(11): base is a locked nucleic acid
cyacacctrtcaacataat

SEQ ID NO: 12148 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (15)..(15): base is a locked nucleic acid
cyacacctrtcaacataat

SEQ ID NO: 12149 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (19)..(19): base is a locked nucleic acid
cyacacctrtcaacataat

SEQ ID NO: 12150 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (16)..(16): base is a locked nucleic acid
cyacacctrtcaacataat

SEQ ID NO: 12151 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (14)..(14): base is a locked nucleic acid
cyacacctrtcaacataat

SEQ ID NO: 12152 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (5)..(5): base is a locked nucleic acid
ccyacacctgtcaacataa

SEQ ID NO: 12153 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
ccyacacctgtcaacataa

SEQ ID NO: 12154 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (3)..(3): base is a locked nucleic acid
ccyacacctgtcaacataa

SEQ ID NO: 12155 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (8)..(8): base is a locked nucleic acid
ccyacacctgtcaacataa

SEQ ID NO: 12156 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (15)..(15): base is a locked nucleic acid
ccyacacctgtcaacataa

SEQ ID NO: 12157 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (16)..(16): base is a locked nucleic acid
ccyacacctgtcaacataa

SEQ ID NO: 12158 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (17)..(17): base is a locked nucleic acid
ccyacacctgtcaacataa

SEQ ID NO: 12159 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (13)..(13): base is a locked nucleic acid
ccyacacctgtcaacataa

SEQ ID NO: 12160 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (4)..(4): base is a locked nucleic acid
  modified_base (9)..(9): base is a locked nucleic acid
  modified_base (11)..(11): base is a locked nucleic acid
ccyacacctgtcaacataa

SEQ ID NO: 12161 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (3)..(3): base is a locked nucleic acid
  modified_base (9)..(9): base is a locked nucleic acid
  modified_base (11)..(11): base is a locked nucleic acid
ccyacacctgtcaacataa

SEQ ID NO: 12162 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (2)..(2): base is a locked nucleic acid
  modified_base (9)..(9): base is a locked nucleic acid
  modified_base (11)..(11): base is a locked nucleic acid
ccyacacctgtcaacataa

SEQ ID NO: 12163 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (8)..(8): base is a locked nucleic acid
  modified_base (9)..(9): base is a locked nucleic acid
  modified_base (11)..(11): base is a locked nucleic acid
ccyacacctgtcaacataa

SEQ ID NO: 12164 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (13)..(13): base is a locked nucleic acid
ccyacacctgtcaacataa

SEQ ID NO: 12165 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (16)..(16): base is a locked nucleic acid
ccyacacctgtcaacataa

SEQ ID NO: 12166 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (14)..(14): base is a locked nucleic acid
ccyacacctgtcaacataa

SEQ ID NO: 12167 - DNA, 19 bp, Artificial Sequence
  Oligonucleotide probe
  misc_binding (1)..(19): Hybridization probe for the specific detection of wild-type HIV-1 at codon 82 of the protease gene.
  modified_base (9)..(9): base is a locked nucleic acid
  modified_base (11)..(11): base is a locked nucleic acid
  modified_base (18)..(18): base is a locked nucleic acid
ccyacacctgtcaacataa

SEQ ID NO: 12168 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (5)..(5): base is a locked nucleic acid
yacacctrtcaacataa

SEQ ID NO: 12169 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (3)..(3): base is a locked nucleic acid
yacacctrtcaacataa

SEQ ID NO: 12170 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (6)..(6): base is a locked nucleic acid
yacacctrtcaacataa

SEQ ID NO: 12171 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
yacacctrtcaacataa

SEQ ID NO: 12172 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (16)..(16): base is a locked nucleic acid
yacacctrtcaacataa

SEQ ID NO: 12173 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (15)..(15): base is a locked nucleic acid
yacacctrtcaacataa

SEQ ID NO: 12174 - DNA, 17 bp, Artificial Sequence
  Oligonucleotide probe
  misc_binding (1)..(17): Hybridization probe for the specific detection of wild-type HIV-1 at codon 82 of the protease gene.
yacacctrtcaacataa

SEQ ID NO: 12175 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (12)..(12): base is a locked nucleic acid
yacacctrtcaacataa

SEQ ID NO: 12176 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (4)..(4): base is a locked nucleic acid
  modified_base (8)..(8): base is a locked nucleic acid
  modified_base (10)..(10): base is a locked nucleic acid
yacacctrtcaacataa

SEQ ID NO: 12177 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (3)..(3): base is a locked nucleic acid
  modified_base (8)..(8): base is a locked nucleic acid
  modified_base (10)..(10): base is a locked nucleic acid
yacacctrtcaacataa

SEQ ID NO: 12178 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (7)..(7): base is a locked nucleic acid
  modified_base (8)..(8): base is a locked nucleic acid
  modified_base (10)..(10): base is a locked nucleic acid
yacacctrtcaacataa

SEQ ID NO: 12179 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (1)..(1): base is a locked nucleic acid
  modified_base (8)..(8): base is a locked nucleic acid
  modified_base (10)..(10): base is a locked nucleic acid
yacacctrtcaacataa

SEQ ID NO: 12180 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (14)..(14): base is a locked nucleic acid
yacacctrtcaacataa

SEQ ID NO: 12181 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
yacacctrtcaacataa

SEQ ID NO: 12182 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (15)..(15): base is a locked nucleic acid
yacacctrtcaacataa

SEQ ID NO: 12183 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (13)..(13): base is a locked nucleic acid
yacacctrtcaacataa

SEQ ID NO: 12184 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (4)..(4): base is a locked nucleic acid
cyacacctgtcaacata

SEQ ID NO: 12185 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
cyacacctgtcaacata

SEQ ID NO: 12186 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (2)..(2): base is a locked nucleic acid
cyacacctgtcaacata

SEQ ID NO: 12187 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (7)..(7): base is a locked nucleic acid
cyacacctgtcaacata

SEQ ID NO: 12188 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (14)..(14): base is a locked nucleic acid
cyacacctgtcaacata

SEQ ID NO: 12189 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (15)..(15): base is a locked nucleic acid
cyacacctgtcaacata

SEQ ID NO: 12190 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (16)..(16): base is a locked nucleic acid
cyacacctgtcaacata

SEQ ID NO: 12191 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (12)..(12): base is a locked nucleic acid
cyacacctgtcaacata

SEQ ID NO: 12192 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (3)..(3): base is a locked nucleic acid
  modified_base (8)..(8): base is a locked nucleic acid
  modified_base (10)..(10): base is a locked nucleic acid
cyacacctgtcaacata

SEQ ID NO: 12193 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (2)..(2): base is a locked nucleic acid
  modified_base (8)..(8): base is a locked nucleic acid
  modified_base (10)..(10): base is a locked nucleic acid
cyacacctgtcaacata

SEQ ID NO: 12194 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (1)..(1): base is a locked nucleic acid
  modified_base (8)..(8): base is a locked nucleic acid
  modified_base (10)..(10): base is a locked nucleic acid
cyacacctgtcaacata

SEQ ID NO: 12195 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (7)..(7): base is a locked nucleic acid
  modified_base (8)..(8): base is a locked nucleic acid
  modified_base (10)..(10): base is a locked nucleic acid
cyacacctgtcaacata

SEQ ID NO: 12196 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (12)..(12): base is a locked nucleic acid
cyacacctgtcaacata

SEQ ID NO: 12197 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (15)..(15): base is a locked nucleic acid
cyacacctgtcaacata

SEQ ID NO: 12198 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (13)..(13): base is a locked nucleic acid
cyacacctgtcaacata

SEQ ID NO: 12199 - DNA, 17 bp, Artificial Sequence
  Oligonucleotide probe
  misc_binding (1)..(17): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (17)..(17): base is a locked nucleic acid
cyacacctgtcaacata

SEQ ID NO: 12200 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (5)..(5): base is a locked nucleic acid
yacacctrtcaacat

SEQ ID NO: 12201 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (3)..(3): base is a locked nucleic acid
yacacctrtcaacat

SEQ ID NO: 12202 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (6)..(6): base is a locked nucleic acid
yacacctrtcaacat

SEQ ID NO: 12203 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
yacacctrtcaacat

SEQ ID NO: 12204 - DNA, 15 bp, Artificial Sequence
  Oligonucleotide probe
  misc_binding (1)..(15): Hybridization probe for the specific detection of wild-type HIV-1 at codon 82 of the protease gene.
yacacctrtcaacat

SEQ ID NO: 12205 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (15)..(15): base is a locked nucleic acid
yacacctrtcaacat

SEQ ID NO: 12206 - DNA, 16 bp, Artificial Sequence
  Oligonucleotide probe
  misc_binding (1)..(16): Hybridization probe for the specific detection of wild-type HIV-1 at codon 82 of the protease gene.
yacacctrtcaacata

SEQ ID NO: 12207 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (12)..(12): base is a locked nucleic acid
yacacctrtcaacat

SEQ ID NO: 12208 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (4)..(4): base is a locked nucleic acid
  modified_base (8)..(8): base is a locked nucleic acid
  modified_base (10)..(10): base is a locked nucleic acid
yacacctrtcaacat

SEQ ID NO: 12209 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (3)..(3): base is a locked nucleic acid
  modified_base (8)..(8): base is a locked nucleic acid
  modified_base (10)..(10): base is a locked nucleic acid
yacacctrtcaacat

SEQ ID NO: 12210 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (7)..(7): base is a locked nucleic acid
  modified_base (8)..(8): base is a locked nucleic acid
  modified_base (10)..(10): base is a locked nucleic acid
yacacctrtcaacat

SEQ ID NO: 12211 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (1)..(1): base is a locked nucleic acid
  modified_base (8)..(8): base is a locked nucleic acid
  modified_base (10)..(10): base is a locked nucleic acid
yacacctrtcaacat

SEQ ID NO: 12212 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (14)..(14): base is a locked nucleic acid
yacacctrtcaacat

SEQ ID NO: 12213 - DNA, 16 bp, Artificial Sequence
  Oligonucleotide probe
  misc_binding (1)..(16): Hybridization probe for the specific detection of wild-type HIV-1 at codon 82 of the protease gene.
  modified_base (8)..(8): base is a locked nucleic acid
  modified_base (10)..(10): base is a locked nucleic acid
yacacctrtcaacata

SEQ ID NO: 12214 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (15)..(15): base is a locked nucleic acid
yacacctrtcaacat

SEQ ID NO: 12215 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (13)..(13): base is a locked nucleic acid
yacacctrtcaacat

SEQ ID NO: 12216 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (4)..(4): base is a locked nucleic acid
cyacacctgtcaaca

SEQ ID NO: 12217 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
cyacacctgtcaaca

SEQ ID NO: 12218 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (2)..(2): base is a locked nucleic acid
cyacacctgtcaaca

SEQ ID NO: 12219 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (7)..(7): base is a locked nucleic acid
cyacacctgtcaaca

SEQ ID NO: 12220 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (14)..(14): base is a locked nucleic acid
cyacacctgtcaaca

SEQ ID NO: 12221 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (15)..(15): base is a locked nucleic acid
cyacacctgtcaaca

SEQ ID NO: 12222 - DNA, 15 bp, Artificial Sequence
  Oligonucleotide probe
  misc_binding (1)..(15): Hybridization probe for the specific detection of wild-type HIV-1 at codon 82 of the protease gene.
cyacacctgtcaaca

SEQ ID NO: 12223 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (12)..(12): base is a locked nucleic acid
cyacacctgtcaaca

SEQ ID NO: 12224 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (3)..(3): base is a locked nucleic acid
  modified_base (8)..(8): base is a locked nucleic acid
  modified_base (10)..(10): base is a locked nucleic acid
cyacacctgtcaaca

SEQ ID NO: 12225 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (2)..(2): base is a locked nucleic acid
  modified_base (8)..(8): base is a locked nucleic acid
  modified_base (10)..(10): base is a locked nucleic acid
cyacacctgtcaaca

SEQ ID NO: 12226 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (1)..(1): base is a locked nucleic acid
  modified_base (8)..(8): base is a locked nucleic acid
  modified_base (10)..(10): base is a locked nucleic acid
cyacacctgtcaaca

SEQ ID NO: 12227 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (7)..(7): base is a locked nucleic acid
  modified_base (8)..(8): base is a locked nucleic acid
  modified_base (10)..(10): base is a locked nucleic acid
cyacacctgtcaaca

SEQ ID NO: 12228 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (12)..(12): base is a locked nucleic acid
cyacacctgtcaaca

SEQ ID NO: 12229 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (15)..(15): base is a locked nucleic acid
cyacacctgtcaaca

SEQ ID NO: 12230 - DNA, 15 bp, Artificial Sequence
  Oligonucleotide probe
  misc_binding (1)..(15): Hybridization probe for the specific detection of wild-type HIV-1 at codon 82 of the protease gene.
  modified_base (8)..(8): base is a locked nucleic acid
  modified_base (10)..(10): base is a locked nucleic acid
  modified_base (13)..(13): base is a locked nucleic acid
cyacacctgtcaaca

SEQ ID NO: 12231 - DNA, 16 bp, Artificial Sequence
  Oligonucleotide probe
  misc_binding (1)..(16): Hybridization probe for the specific detection of wild-type HIV-1 at codon 82 of the protease gene.
  modified_base (8)..(8): base is a locked nucleic acid
  modified_base (10)..(10): base is a locked nucleic acid
cyacacctgtcaacat

SEQ ID NO: 12232 - DNA, 15 bp, Artificial Sequence
  Oligonucleotide probe
  misc_binding (1)..(15): Hybridization probe for the specific detection of wild-type HIV-1 at codon 82 of the protease gene.
acacctgtyaacata

SEQ ID NO: 12233 - DNA, 20 bp, Artificial Sequence
  Oligonucleotide probe
  misc_binding (1)..(20): Hybridization probe for the specific detection of wild-type HIV-1 at codon 82 of the protease gene.
cyacacctrtcaacataatt

SEQ ID NO: 12234 - DNA, 20 bp, Artificial Sequence
  Oligonucleotide probe
  misc_binding (1)..(20): Hybridization probe for the specific detection of wild-type HIV-1 at codon 82 of the protease gene.
ccyacacctgtcaacataat

SEQ ID NO: 12235 - DNA, 19 bp, Artificial Sequence
  Oligonucleotide probe
  misc_binding (1)..(19): Hybridization probe for the specific detection of wild-type HIV-1 at codon 82 of the protease gene.
cyacacctrtcaacataat

SEQ ID NO: 12236 - DNA, 19 bp, Artificial Sequence
  Oligonucleotide probe
  misc_binding (1)..(19): Hybridization probe for the specific detection of wild-type HIV-1 at codon 82 of the protease gene.
ccyacacctgtcaacataa

SEQ ID NO: 12237 - DNA, 17 bp, Artificial Sequence
  Oligonucleotide probe
  misc_binding (1)..(17): Hybridization probe for the specific detection of wild-type HIV-1 at codon 82 of the protease gene.
yacacctrtcaacataa

SEQ ID NO: 12238 - DNA, 17 bp, Artificial Sequence
  Oligonucleotide probe
  misc_binding (1)..(17): Hybridization probe for the specific detection of wild-type HIV-1 at codon 82 of the protease gene.
cyacacctgtcaacata

SEQ ID NO: 12239 - DNA, 15 bp, Artificial Sequence
  Oligonucleotide probe
  misc_binding (1)..(15): Hybridization probe for the specific detection of wild-type HIV-1 at codon 82 of the protease gene.
yacacctrtcaacat

SEQ ID NO: 12240 - DNA, 15 bp, Artificial Sequence
  Oligonucleotide probe
  misc_binding (1)..(15): Hybridization probe for the specific detection of wild-type HIV-1 at codon 82 of the protease gene.
cyacacctgtcaaca

SEQ ID NO: 12241 - DNA, 16 bp, Artificial Sequence
  Oligonucleotide probe
  misc_binding (1)..(16): Hybridization probe for the specific detection of wild-type HIV-1 at codon 82 of the protease gene.
cyacacctgtcaacat

SEQ ID NO: 12242 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (5)..(5): base is a locked nucleic acid
acacctrtcaacataattgg

SEQ ID NO: 12243 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (3)..(3): base is a locked nucleic acid
acacctrtcaacataattgg

SEQ ID NO: 12244 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (6)..(6): base is a locked nucleic acid
acacctrtcaacataattgg

SEQ ID NO: 12245 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (9)..(9): base is a locked nucleic acid
acacctrtcaacataattgg

SEQ ID NO: 12246 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (16)..(16): base is a locked nucleic acid
acacctrtcaacataattgg

SEQ ID NO: 12247 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (17)..(17): base is a locked nucleic acid
acacctrtcaacataattgg

SEQ ID NO: 12248 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (12)..(12): base is a locked nucleic acid
acacctrtcaacataattgg

SEQ ID NO: 12249 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (15)..(15): base is a locked nucleic acid
acacctrtcaacataattgg

SEQ ID NO: 12250 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (3)..(3): base is a locked nucleic acid
  modified_base (9)..(9): base is a locked nucleic acid
  modified_base (11)..(11): base is a locked nucleic acid
acacctrtcaacataattgg

SEQ ID NO: 12251 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (7)..(7): base is a locked nucleic acid
  modified_base (9)..(9): base is a locked nucleic acid
  modified_base (11)..(11): base is a locked nucleic acid
acacctrtcaacataattgg

SEQ ID NO: 12252 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (2)..(2): base is a locked nucleic acid
  modified_base (9)..(9): base is a locked nucleic acid
  modified_base (11)..(11): base is a locked nucleic acid
acacctrtcaacataattgg

SEQ ID NO: 12253 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (6)..(6): base is a locked nucleic acid
  modified_base (9)..(9): base is a locked nucleic acid
  modified_base (11)..(11): base is a locked nucleic acid
acacctrtcaacataattgg

SEQ ID NO: 12254 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (18)..(18): base is a locked nucleic acid
acacctrtcaacataattgg

SEQ ID NO: 12255 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (14)..(14): base is a locked nucleic acid
acacctrtcaacataattgg

SEQ ID NO: 12256 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (19)..(19): base is a locked nucleic acid
acacctrtcaacataattgg

SEQ ID NO: 12257 - DNA, 20 bp, Artificial Sequence
  Oligonucleotide probe
  misc_binding (1)..(20): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (12)..(12): base is a locked nucleic acid
acacctrtcaacataattgg

SEQ ID NO: 12258 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (5)..(5): base is a locked nucleic acid
acacctrtcaacataattg

SEQ ID NO: 12259 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (3)..(3): base is a locked nucleic acid
acacctrtcaacataattg

SEQ ID NO: 12260 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (6)..(6): base is a locked nucleic acid
acacctrtcaacataattg

SEQ ID NO: 12261 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (9)..(9): base is a locked nucleic acid
acacctrtcaacataattg

SEQ ID NO: 12262 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (16)..(16): base is a locked nucleic acid
acacctrtcaacataattg

SEQ ID NO: 12263 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (17)..(17): base is a locked nucleic acid
acacctrtcaacataattg

SEQ ID NO: 12264 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (12)..(12): base is a locked nucleic acid
acacctrtcaacataattg

SEQ ID NO: 12265 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (15)..(15): base is a locked nucleic acid
acacctrtcaacataattg

SEQ ID NO: 12266 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (3)..(3): base is a locked nucleic acid
  modified_base (9)..(9): base is a locked nucleic acid
  modified_base (11)..(11): base is a locked nucleic acid
acacctrtcaacataattg

SEQ ID NO: 12267 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (7)..(7): base is a locked nucleic acid
  modified_base (9)..(9): base is a locked nucleic acid
  modified_base (11)..(11): base is a locked nucleic acid
acacctrtcaacataattg

SEQ ID NO: 12268 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (2)..(2): base is a locked nucleic acid
  modified_base (9)..(9): base is a locked nucleic acid
  modified_base (11)..(11): base is a locked nucleic acid
acacctrtcaacataattg

SEQ ID NO: 12269 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (6)..(6): base is a locked nucleic acid
  modified_base (9)..(9): base is a locked nucleic acid
  modified_base (11)..(11): base is a locked nucleic acid
acacctrtcaacataattg

SEQ ID NO: 12270 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (18)..(18): base is a locked nucleic acid
acacctrtcaacataattg

SEQ ID NO: 12271 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (14)..(14): base is a locked nucleic acid
acacctrtcaacataattg

SEQ ID NO: 12272 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (19)..(19): base is a locked nucleic acid
acacctrtcaacataattg

SEQ ID NO: 12273 - DNA, 19 bp, Artificial Sequence
  Oligonucleotide probe
  misc_binding (1)..(19): Hybridization probe for the specific detection of wild-type HIV-1 at codon 83 of the protease gene.
  modified_base (9)..(9): base is a locked nucleic acid
  modified_base (11)..(11): base is a locked nucleic acid
  modified_base (12)..(12): base is a locked nucleic acid
acacctrtcaacataattg

SEQ ID NO: 12274 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (4)..(4): base is a locked nucleic acid
cacctrtcaacataatt

SEQ ID NO: 12275 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (2)..(2): base is a locked nucleic acid
cacctrtcaacataatt

SEQ ID NO: 12276 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (5)..(5): base is a locked nucleic acid
cacctrtcaacataatt

SEQ ID NO: 12277 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (8)..(8): base is a locked nucleic acid
cacctrtcaacataatt

SEQ ID NO: 12278 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (15)..(15): base is a locked nucleic acid
cacctrtcaacataatt

SEQ ID NO: 12279 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (16)..(16): base is a locked nucleic acid
cacctrtcaacataatt

SEQ ID NO: 12280 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (11)..(11): base is a locked nucleic acid
cacctrtcaacataatt

SEQ ID NO: 12281 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (14)..(14): base is a locked nucleic acid
cacctrtcaacataatt

SEQ ID NO: 12282 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (2)..(2): base is a locked nucleic acid
  modified_base (8)..(8): base is a locked nucleic acid
  modified_base (10)..(10): base is a locked nucleic acid
cacctrtcaacataatt

SEQ ID NO: 12283 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (6)..(6): base is a locked nucleic acid
  modified_base (8)..(8): base is a locked nucleic acid
  modified_base (10)..(10): base is a locked nucleic acid
cacctrtcaacataatt

SEQ ID NO: 12284 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (1)..(1): base is a locked nucleic acid
  modified_base (8)..(8): base is a locked nucleic acid
  modified_base (10)..(10): base is a locked nucleic acid
cacctrtcaacataatt

SEQ ID NO: 12285 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (5)..(5): base is a locked nucleic acid
  modified_base (8)..(8): base is a locked nucleic acid
  modified_base (10)..(10): base is a locked nucleic acid
cacctrtcaacataatt

SEQ ID NO: 12286 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (8)..(8): base is a locked nucleic acid
  modified_base (10)..(10): base is a locked nucleic acid
  modified_base (17)..(17): base is a locked nucleic acid
cacctrtcaacataatt

SEQ ID NO: 12287 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (8)..(8): base is a locked nucleic acid
  modified_base (10)..(10): base is a locked nucleic acid
  modified_base (13)..(13): base is a locked nucleic acid
cacctrtcaacataatt

SEQ ID NO: 12288 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (8)..(8): base is a locked nucleic acid
  modified_base (10)..(10): base is a locked nucleic acid
cacctrtcaacataatt

SEQ ID NO: 12289 - DNA, 17 bp, Artificial Sequence
  Oligonucleotide probe
  misc_binding (1)..(17): Hybridization probe for the specific detection of wild-type HIV-1 at codon 83 of the protease gene.
  modified_base (8)..(8): base is a locked nucleic acid
  modified_base (10)..(10): base is a locked nucleic acid
  modified_base (11)..(11): base is a locked nucleic acid
cacctrtcaacataatt

SEQ ID NO: 12290 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (4)..(4): base is a locked nucleic acid
cacctrtcaacataa

SEQ ID NO: 12291 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (2)..(2): base is a locked nucleic acid
cacctrtcaacataa

SEQ ID NO: 12292 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (5)..(5): base is a locked nucleic acid
cacctrtcaacataa

SEQ ID NO: 12293 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (8)..(8): base is a locked nucleic acid
cacctrtcaacataa

SEQ ID NO: 12294 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (15)..(15): base is a locked nucleic acid
cacctrtcaacataa

SEQ ID NO: 12295 - DNA, 15 bp, Artificial Sequence
  Oligonucleotide probe
  misc_binding (1)..(15): Hybridization probe for the specific detection of wild-type HIV-1 at codon 83 of the protease gene.
cacctrtcaacataa

SEQ ID NO: 12296 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (11)..(11): base is a locked nucleic acid
cacctrtcaacataa

SEQ ID NO: 12297 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (14)..(14): base is a locked nucleic acid
cacctrtcaacataa

SEQ ID NO: 12298 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (2)..(2): base is a locked nucleic acid
  modified_base (8)..(8): base is a locked nucleic acid
  modified_base (10)..(10): base is a locked nucleic acid
cacctrtcaacataa

SEQ ID NO: 12299 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (6)..(6): base is a locked nucleic acid
  modified_base (8)..(8): base is a locked nucleic acid
  modified_base (10)..(10): base is a locked nucleic acid
cacctrtcaacataa

SEQ ID NO: 12300 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (1)..(1): base is a locked nucleic acid
  modified_base (8)..(8): base is a locked nucleic acid
  modified_base (10)..(10): base is a locked nucleic acid
cacctrtcaacataa

SEQ ID NO: 12301 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (5)..(5): base is a locked nucleic acid
  modified_base (8)..(8): base is a locked nucleic acid
  modified_base (10)..(10): base is a locked nucleic acid
cacctrtcaacataa

SEQ ID NO: 12302 - DNA, 16 bp, Artificial Sequence
  Oligonucleotide probe
  misc_binding (1)..(16): Hybridization probe for the specific detection of wild-type HIV-1 at codon 83 of the protease gene.
  modified_base (8)..(8): base is a locked nucleic acid
  modified_base (10)..(10): base is a locked nucleic acid
cacctrtcaacataat

SEQ ID NO: 12303 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (8)..(8): base is a locked nucleic acid
  modified_base (10)..(10): base is a locked nucleic acid
  modified_base (13)..(13): base is a locked nucleic acid
cacctrtcaacataa

SEQ ID NO: 12304 - DNA, 15 bp, Artificial Sequence
  Oligonucleotide probe
  misc_binding (1)..(15): Hybridization probe for the specific detection of wild-type HIV-1 at codon 83 of the protease gene.
  modified_base (8)..(8): base is a locked nucleic acid
  modified_base (10)..(10): base is a locked nucleic acid
  modified_base (11)..(11): base is a locked nucleic acid
cacctrtcaacataa

SEQ ID NO: 12305 - DNA, 15 bp, Artificial Sequence
  Oligonucleotide probe
  misc_binding (1)..(15): Hybridization probe for the specific detection of wild-type HIV-1 at codon 83 of the protease gene.
acctgtcaayataat

SEQ ID NO: 12306 - DNA, 20 bp, Artificial Sequence
  Oligonucleotide probe
  misc_binding (1)..(20): Hybridization probe for the specific detection of wild-type HIV-1 at codon 83 of the protease gene.
acacctrtcaacataattgg

SEQ ID NO: 12307 - DNA, 19 bp, Artificial Sequence
  Oligonucleotide probe
  misc_binding (1)..(19): Hybridization probe for the specific detection of wild-type HIV-1 at codon 83 of the protease gene.
acacctrtcaacataattg

SEQ ID NO: 12308 - DNA, 17 bp, Artificial Sequence
  Oligonucleotide probe
  misc_binding (1)..(17): Hybridization probe for the specific detection of wild-type HIV-1 at codon 83 of the protease gene.
cacctrtcaacataatt

SEQ ID NO: 12309 - DNA, 15 bp, Artificial Sequence
  Oligonucleotide probe
  misc_binding (1)..(15): Hybridization probe for the specific detection of wild-type HIV-1 at codon 83 of the protease gene.
cacctrtcaacataa

SEQ ID NO: 12310 - DNA, 16 bp, Artificial Sequence
  Oligonucleotide probe
  misc_binding (1)..(16): Hybridization probe for the specific detection of wild-type HIV-1 at codon 83 of the protease gene.
cacctrtcaacataat

SEQ ID NO: 12311 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (2)..(2): base is a locked nucleic acid
cctrtcaacataattggrmg

SEQ ID NO: 12312 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (3)..(3): base is a locked nucleic acid
cctrtcaacataattggrmg

SEQ ID NO: 12313 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (9)..(9): base is a locked nucleic acid
cctrtcaacataattggrmg

SEQ ID NO: 12314 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (5)..(5): base is a locked nucleic acid
cctrtcaacataattggrmg

SEQ ID NO: 12315 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (15)..(15): base is a locked nucleic acid
cctrtcaacataattggrmg

SEQ ID NO: 12316 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (19)..(19): base is a locked nucleic acid
cctrtcaacataattggrmg

SEQ ID NO: 12317 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (12)..(12): base is a locked nucleic acid
cctrtcaacataattggrmg

SEQ ID NO: 12318 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (13)..(13): base is a locked nucleic acid
cctrtcaacataattggrmg

SEQ ID NO: 12319 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (7)..(7): base is a locked nucleic acid
  modified_base (9)..(9): base is a locked nucleic acid
  modified_base (11)..(11): base is a locked nucleic acid
cctrtcaacataattggrmg

SEQ ID NO: 12320 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (6)..(6): base is a locked nucleic acid
  modified_base (9)..(9): base is a locked nucleic acid
  modified_base (11)..(11): base is a locked nucleic acid
cctrtcaacataattggrmg

SEQ ID NO: 12321 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (3)..(3): base is a locked nucleic acid
  modified_base (9)..(9): base is a locked nucleic acid
  modified_base (11)..(11): base is a locked nucleic acid
cctrtcaacataattggrmg

SEQ ID NO: 12322 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (5)..(5): base is a locked nucleic acid
  modified_base (9)..(9): base is a locked nucleic acid
  modified_base (11)..(11): base is a locked nucleic acid
cctrtcaacataattggrmg

SEQ ID NO: 12323 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (17)..(17): base is a locked nucleic acid
cctrtcaacataattggrmg

SEQ ID NO: 12324 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (12)..(12): base is a locked nucleic acid
cctrtcaacataattggrmg

SEQ ID NO: 12325 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (15)..(15): base is a locked nucleic acid
cctrtcaacataattggrmg

SEQ ID NO: 12326 - DNA, 20 bp, Artificial Sequence
  Oligonucleotide probe
  misc_binding (1)..(20): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (19)..(19): base is a locked nucleic acid
cctrtcaacataattggrmg

SEQ ID NO: 12327 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (2)..(2): base is a locked nucleic acid
cctrtcaacataattggrm

SEQ ID NO: 12328 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (3)..(3): base is a locked nucleic acid
cctrtcaacataattggrm

SEQ ID NO: 12329 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (9)..(9): base is a locked nucleic acid
cctrtcaacataattggrm

SEQ ID NO: 12330 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (5)..(5): base is a locked nucleic acid
cctrtcaacataattggrm

SEQ ID NO: 12331 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (15)..(15): base is a locked nucleic acid
cctrtcaacataattggrm

SEQ ID NO: 12332 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (19)..(19): base is a locked nucleic acid
cctrtcaacataattggrm

SEQ ID NO: 12333 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (12)..(12): base is a locked nucleic acid
cctrtcaacataattggrm

SEQ ID NO: 12334 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (13)..(13): base is a locked nucleic acid
cctrtcaacataattggrm

SEQ ID NO: 12335 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (7)..(7): base is a locked nucleic acid
  modified_base (9)..(9): base is a locked nucleic acid
  modified_base (11)..(11): base is a locked nucleic acid
cctrtcaacataattggrm

SEQ ID NO: 12336 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (6)..(6): base is a locked nucleic acid
  modified_base (9)..(9): base is a locked nucleic acid
  modified_base (11)..(11): base is a locked nucleic acid
cctrtcaacataattggrm

SEQ ID NO: 12337 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (3)..(3): base is a locked nucleic acid
  modified_base (9)..(9): base is a locked nucleic acid
  modified_base (11)..(11): base is a locked nucleic acid
cctrtcaacataattggrm

SEQ ID NO: 12338 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (5)..(5): base is a locked nucleic acid
  modified_base (9)..(9): base is a locked nucleic acid
  modified_base (11)..(11): base is a locked nucleic acid
cctrtcaacataattggrm

SEQ ID NO: 12339 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (17)..(17): base is a locked nucleic acid
cctrtcaacataattggrm

SEQ ID NO: 12340 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (12)..(12): base is a locked nucleic acid
cctrtcaacataattggrm

SEQ ID NO: 12341 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (15)..(15): base is a locked nucleic acid
cctrtcaacataattggrm

SEQ ID NO: 12342 - DNA, 19 bp, Artificial Sequence
  Oligonucleotide probe
  misc_binding (1)..(19): Hybridization probe for the specific detection of wild-type HIV-1 at codon 84 of the protease gene.
  modified_base (9)..(9): base is a locked nucleic acid
  modified_base (11)..(11): base is a locked nucleic acid
  modified_base (19)..(19): base is a locked nucleic acid
cctrtcaacataattggrm

SEQ ID NO: 12343 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (1)..(1): base is a locked nucleic acid
ctrtcaacataattggr

SEQ ID NO: 12344 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (2)..(2): base is a locked nucleic acid
ctrtcaacataattggr

SEQ ID NO: 12345 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (8)..(8): base is a locked nucleic acid
ctrtcaacataattggr

SEQ ID NO: 12346 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (4)..(4): base is a locked nucleic acid
ctrtcaacataattggr

SEQ ID NO: 12347 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (14)..(14): base is a locked nucleic acid
ctrtcaacataattggr

SEQ ID NO: 12348 - DNA, 17 bp, Artificial Sequence
  Oligonucleotide probe
  misc_binding (1)..(17): Hybridization probe for the specific detection of wild-type HIV-1 at codon 84 of the protease gene.
ctrtcaacataattggr

SEQ ID NO: 12349 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (11)..(11): base is a locked nucleic acid
ctrtcaacataattggr

SEQ ID NO: 12350 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (12)..(12): base is a locked nucleic acid
ctrtcaacataattggr

SEQ ID NO: 12351 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (6)..(6): base is a locked nucleic acid
  modified_base (8)..(8): base is a locked nucleic acid
  modified_base (10)..(10): base is a locked nucleic acid
ctrtcaacataattggr

SEQ ID NO: 12352 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (5)..(5): base is a locked nucleic acid
  modified_base (8)..(8): base is a locked nucleic acid
  modified_base (10)..(10): base is a locked nucleic acid
ctrtcaacataattggr

SEQ ID NO: 12353 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (2)..(2): base is a locked nucleic acid
  modified_base (8)..(8): base is a locked nucleic acid
  modified_base (10)..(10): base is a locked nucleic acid
ctrtcaacataattggr

SEQ ID NO: 12354 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (4)..(4): base is a locked nucleic acid
  modified_base (8)..(8): base is a locked nucleic acid
  modified_base (10)..(10): base is a locked nucleic acid
ctrtcaacataattggr

SEQ ID NO: 12355 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (8)..(8): base is a locked nucleic acid
  modified_base (10)..(10): base is a locked nucleic acid
  modified_base (16)..(16): base is a locked nucleic acid
ctrtcaacataattggr

SEQ ID NO: 12356 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (8)..(8): base is a locked nucleic acid
  modified_base (10)..(10): base is a locked nucleic acid
  modified_base (11)..(11): base is a locked nucleic acid
ctrtcaacataattggr

SEQ ID NO: 12357 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (8)..(8): base is a locked nucleic acid
  modified_base (10)..(10): base is a locked nucleic acid
  modified_base (14)..(14): base is a locked nucleic acid
ctrtcaacataattggr

SEQ ID NO: 12358 - DNA, 17 bp, Artificial Sequence
  Oligonucleotide probe
  misc_binding (1)..(17): Hybridization probe for the specific detection of wild-type HIV-1 at codon 84 of the protease gene.
  modified_base (8)..(8): base is a locked nucleic acid
  modified_base (10)..(10): base is a locked nucleic acid
ctrtcaacataattggr

SEQ ID NO: 12359 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (1)..(1): base is a locked nucleic acid
ctrtcaacataattg

SEQ ID NO: 12360 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (2)..(2): base is a locked nucleic acid
ctrtcaacataattg

SEQ ID NO: 12361 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (8)..(8): base is a locked nucleic acid
ctrtcaacataattg

SEQ ID NO: 12362 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (4)..(4): base is a locked nucleic acid
ctrtcaacataattg

SEQ ID NO: 12363 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (14)..(14): base is a locked nucleic acid
ctrtcaacataattg

SEQ ID NO: 12364 - DNA, 16 bp, Artificial Sequence
  Oligonucleotide probe
  misc_binding (1)..(16): Hybridization probe for the specific detection of wild-type HIV-1 at codon 84 of the protease gene.
ctrtcaacataattgg

SEQ ID NO: 12365 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (11)..(11): base is a locked nucleic acid
ctrtcaacataattg

SEQ ID NO: 12366 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (12)..(12): base is a locked nucleic acid
ctrtcaacataattg

SEQ ID NO: 12367 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (6)..(6): base is a locked nucleic acid
  modified_base (8)..(8): base is a locked nucleic acid
  modified_base (10)..(10): base is a locked nucleic acid
ctrtcaacataattg

SEQ ID NO: 12368 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (5)..(5): base is a locked nucleic acid
  modified_base (8)..(8): base is a locked nucleic acid
  modified_base (10)..(10): base is a locked nucleic acid
ctrtcaacataattg

SEQ ID NO: 12369 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (2)..(2): base is a locked nucleic acid
  modified_base (8)..(8): base is a locked nucleic acid
  modified_base (10)..(10): base is a locked nucleic acid
ctrtcaacataattg

SEQ ID NO: 12370 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (4)..(4): base is a locked nucleic acid
  modified_base (8)..(8): base is a locked nucleic acid
  modified_base (10)..(10): base is a locked nucleic acid
ctrtcaacataattg

SEQ ID NO: 12371 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (8)..(8): base is a locked nucleic acid
  modified_base (10)..(10): base is a locked nucleic acid
ctrtcaacataattg

SEQ ID NO: 12372 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (8)..(8): base is a locked nucleic acid
  modified_base (10)..(10): base is a locked nucleic acid
  modified_base (11)..(11): base is a locked nucleic acid
ctrtcaacataattg

SEQ ID NO: 12373 - DNA, 15 bp, Artificial Sequence
  Oligonucleotide probe
  misc_binding (1)..(15): Hybridization probe for the specific detection of wild-type HIV-1 at codon 84 of the protease gene.
  modified_base (8)..(8): base is a locked nucleic acid
  modified_base (10)..(10): base is a locked nucleic acid
  modified_base (14)..(14): base is a locked nucleic acid
ctrtcaacataattg

SEQ ID NO: 12374 - DNA, 16 bp, Artificial Sequence
  Oligonucleotide probe
  misc_binding (1)..(16): Hybridization probe for the specific detection of wild-type HIV-1 at codon 84 of the protease gene.
  modified_base (8)..(8): base is a locked nucleic acid
  modified_base (10)..(10): base is a locked nucleic acid
ctrtcaacataattgg

SEQ ID NO: 12375 - DNA, 15 bp, Artificial Sequence
  Oligonucleotide probe
  misc_binding (1)..(15): Hybridization probe for the specific detection of wild-type HIV-1 at codon 84 of the protease gene.
tccaattatgttgac

SEQ ID NO: 12376 - DNA, 20 bp, Artificial Sequence
  Oligonucleotide probe
  misc_binding (1)..(20): Hybridization probe for the specific detection of wild-type HIV-1 at codon 84 of the protease gene.
cctrtcaacataattggrmg

SEQ ID NO: 12377 - DNA, 19 bp, Artificial Sequence
  Oligonucleotide probe
  misc_binding (1)..(19): Hybridization probe for the specific detection of wild-type HIV-1 at codon 84 of the protease gene.
cctrtcaacataattggrm

SEQ ID NO: 12378 - DNA, 17 bp, Artificial Sequence
  Oligonucleotide probe
  misc_binding (1)..(17): Hybridization probe for the specific detection of wild-type HIV-1 at codon 84 of the protease gene.
ctrtcaacataattggr

SEQ ID NO: 12379 - DNA, 15 bp, Artificial Sequence
  Oligonucleotide probe
  misc_binding (1)..(15): Hybridization probe for the specific detection of wild-type HIV-1 at codon 84 of the protease gene.
ctrtcaacataattg

SEQ ID NO: 12380 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (2)..(2): base is a locked nucleic acid
ttggrmgraayhtgttgacy

SEQ ID NO: 12381 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (5)..(5): base is a locked nucleic acid
ttggrmgraayhtgttgacy

SEQ ID NO: 12382 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (4)..(4): base is a locked nucleic acid
ttggrmgraayhtgttgacy

SEQ ID NO: 12383 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (3)..(3): base is a locked nucleic acid
ttggrmgraayhtgttgacy

SEQ ID NO: 12384 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (19)..(19): base is a locked nucleic acid
ttggrmgraayhtgttgacy

SEQ ID NO: 12385 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (17)..(17): base is a locked nucleic acid
ttggrmgraayhtgttgacy

SEQ ID NO: 12386 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (15)..(15): base is a locked nucleic acid
ttggrmgraayhtgttgacy

SEQ ID NO: 12387 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (13)..(13): base is a locked nucleic acid
ttggrmgraayhtgttgacy

SEQ ID NO: 12388 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (7)..(7): base is a locked nucleic acid
  modified_base (9)..(9): base is a locked nucleic acid
  modified_base (11)..(11): base is a locked nucleic acid
ttggrmgraayhtgttgacy

SEQ ID NO: 12389 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (3)..(3): base is a locked nucleic acid
  modified_base (9)..(9): base is a locked nucleic acid
  modified_base (11)..(11): base is a locked nucleic acid
ttggrmgraayhtgttgacy

SEQ ID NO: 12390 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (8)..(8): base is a locked nucleic acid
  modified_base (9)..(9): base is a locked nucleic acid
  modified_base (11)..(11): base is a locked nucleic acid
ttggrmgraayhtgttgacy

SEQ ID NO: 12391 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (6)..(6): base is a locked nucleic acid
  modified_base (9)..(9): base is a locked nucleic acid
  modified_base (11)..(11): base is a locked nucleic acid
ttggrmgraayhtgttgacy

SEQ ID NO: 12392 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (19)..(19): base is a locked nucleic acid
ttggrmgraayhtgttgacy

SEQ ID NO: 12393 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (12)..(12): base is a locked nucleic acid
ttggrmgraayhtgttgacy

SEQ ID NO: 12394 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (15)..(15): base is a locked nucleic acid
ttggrmgraayhtgttgacy

SEQ ID NO: 12395 - DNA, 20 bp, Artificial Sequence
  Oligonucleotide probe
  misc_binding (1)..(20): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (13)..(13): base is a locked nucleic acid
ttggrmgraayhtgttgacy

SEQ ID NO: 12396 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (2)..(2): base is a locked nucleic acid
ttggrmgraayhtgttgac

SEQ ID NO: 12397 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (5)..(5): base is a locked nucleic acid
ttggrmgraayhtgttgac

SEQ ID NO: 12398 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (4)..(4): base is a locked nucleic acid
ttggrmgraayhtgttgac

SEQ ID NO: 12399 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (3)..(3): base is a locked nucleic acid
ttggrmgraayhtgttgac

SEQ ID NO: 12400 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (19)..(19): base is a locked nucleic acid
ttggrmgraayhtgttgac

SEQ ID NO: 12401 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (17)..(17): base is a locked nucleic acid
ttggrmgraayhtgttgac

SEQ ID NO: 12402 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (15)..(15): base is a locked nucleic acid
ttggrmgraayhtgttgac

SEQ ID NO: 12403 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (13)..(13): base is a locked nucleic acid
ttggrmgraayhtgttgac

SEQ ID NO: 12404 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (7)..(7): base is a locked nucleic acid
  modified_base (9)..(9): base is a locked nucleic acid
  modified_base (11)..(11): base is a locked nucleic acid
ttggrmgraayhtgttgac

SEQ ID NO: 12405 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (3)..(3): base is a locked nucleic acid
  modified_base (9)..(9): base is a locked nucleic acid
  modified_base (11)..(11): base is a locked nucleic acid
ttggrmgraayhtgttgac

SEQ ID NO: 12406 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (8)..(8): base is a locked nucleic acid
  modified_base (9)..(9): base is a locked nucleic acid
  modified_base (11)..(11): base is a locked nucleic acid
ttggrmgraayhtgttgac

SEQ ID NO: 12407 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (6)..(6): base is a locked nucleic acid
  modified_base (9)..(9): base is a locked nucleic acid
  modified_base (11)..(11): base is a locked nucleic acid
ttggrmgraayhtgttgac

SEQ ID NO: 12408 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (19)..(19): base is a locked nucleic acid
ttggrmgraayhtgttgac

SEQ ID NO: 12409 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (12)..(12): base is a locked nucleic acid
ttggrmgraayhtgttgac

SEQ ID NO: 12410 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (15)..(15): base is a locked nucleic acid
ttggrmgraayhtgttgac

SEQ ID NO: 12411 - DNA, 19 bp, Artificial Sequence
  Oligonucleotide probe
  misc_binding (1)..(19): Hybridization probe for the specific detection of wild-type HIV-1 at codon 88 of the protease gene.
  modified_base (9)..(9): base is a locked nucleic acid
  modified_base (11)..(11): base is a locked nucleic acid
  modified_base (13)..(13): base is a locked nucleic acid
ttggrmgraayhtgttgac

SEQ ID NO: 12412 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (1)..(1): base is a locked nucleic acid
tggrmgraayhtgttga

SEQ ID NO: 12413 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (4)..(4): base is a locked nucleic acid
tggrmgraayhtgttga

SEQ ID NO: 12414 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (3)..(3): base is a locked nucleic acid
tggrmgraayhtgttga

SEQ ID NO: 12415 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (2)..(2): base is a locked nucleic acid
tggrmgraayhtgttga

SEQ ID NO: 12416 - DNA, 17 bp, Artificial Sequence
  Oligonucleotide probe
  misc_binding (1)..(17): Hybridization probe for the specific detection of wild-type HIV-1 at codon 88 of the protease gene.
tggrmgraayhtgttga

SEQ ID NO: 12417 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (16)..(16): base is a locked nucleic acid
tggrmgraayhtgttga

SEQ ID NO: 12418 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (14)..(14): base is a locked nucleic acid
tggrmgraayhtgttga

SEQ ID NO: 12419 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (12)..(12): base is a locked nucleic acid
tggrmgraayhtgttga

SEQ ID NO: 12420 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (6)..(6): base is a locked nucleic acid
  modified_base (8)..(8): base is a locked nucleic acid
  modified_base (10)..(10): base is a locked nucleic acid
tggrmgraayhtgttga

SEQ ID NO: 12421 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (2)..(2): base is a locked nucleic acid
  modified_base (8)..(8): base is a locked nucleic acid
  modified_base (10)..(10): base is a locked nucleic acid
tggrmgraayhtgttga

SEQ ID NO: 12422 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (7)..(7): base is a locked nucleic acid
  modified_base (8)..(8): base is a locked nucleic acid
  modified_base (10)..(10): base is a locked nucleic acid
tggrmgraayhtgttga

SEQ ID NO: 12423 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (5)..(5): base is a locked nucleic acid
  modified_base (8)..(8): base is a locked nucleic acid
  modified_base (10)..(10): base is a locked nucleic acid
tggrmgraayhtgttga

SEQ ID NO: 12424 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (8)..(8): base is a locked nucleic acid
  modified_base (10)..(10): base is a locked nucleic acid
tggrmgraayhtgttga

SEQ ID NO: 12425 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (8)..(8): base is a locked nucleic acid
  modified_base (10)..(10): base is a locked nucleic acid
  modified_base (11)..(11): base is a locked nucleic acid
tggrmgraayhtgttga

SEQ ID NO: 12426 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (8)..(8): base is a locked nucleic acid
  modified_base (10)..(10): base is a locked nucleic acid
  modified_base (14)..(14): base is a locked nucleic acid
tggrmgraayhtgttga

SEQ ID NO: 12427 - DNA, 17 bp, Artificial Sequence
  Oligonucleotide probe
  misc_binding (1)..(17): Hybridization probe for the specific detection of wild-type HIV-1 at codon 88 of the protease gene.
  modified_base (8)..(8): base is a locked nucleic acid
  modified_base (10)..(10): base is a locked nucleic acid
  modified_base (12)..(12): base is a locked nucleic acid
tggrmgraayhtgttga

SEQ ID NO: 12428 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (1)..(1): base is a locked nucleic acid
tggrmgraayhtgtt

SEQ ID NO: 12429 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (4)..(4): base is a locked nucleic acid
tggrmgraayhtgtt

SEQ ID NO: 12430 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (3)..(3): base is a locked nucleic acid
tggrmgraayhtgtt

SEQ ID NO: 12431 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (2)..(2): base is a locked nucleic acid
tggrmgraayhtgtt

SEQ ID NO: 12432 - DNA, 16 bp, Artificial Sequence
  Oligonucleotide probe
  misc_binding (1)..(16): Hybridization probe for the specific detection of wild-type HIV-1 at codon 88 of the protease gene.
tggrmgraayhtgttg

SEQ ID NO: 12433 - DNA, 15 bp, Artificial Sequence
  Oligonucleotide probe
  misc_binding (1)..(15): Hybridization probe for the specific detection of wild-type HIV-1 at codon 88 of the protease gene.
tggrmgraayhtgtt

SEQ ID NO: 12434 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (14)..(14): base is a locked nucleic acid
tggrmgraayhtgtt

SEQ ID NO: 12435 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (12)..(12): base is a locked nucleic acid
tggrmgraayhtgtt

SEQ ID NO: 12436 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (6)..(6): base is a locked nucleic acid
  modified_base (8)..(8): base is a locked nucleic acid
  modified_base (10)..(10): base is a locked nucleic acid
tggrmgraayhtgtt

SEQ ID NO: 12437 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (2)..(2): base is a locked nucleic acid
  modified_base (8)..(8): base is a locked nucleic acid
  modified_base (10)..(10): base is a locked nucleic acid
tggrmgraayhtgtt

SEQ ID NO: 12438 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (7)..(7): base is a locked nucleic acid
  modified_base (8)..(8): base is a locked nucleic acid
  modified_base (10)..(10): base is a locked nucleic acid
tggrmgraayhtgtt

SEQ ID NO: 12439 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (5)..(5): base is a locked nucleic acid
  modified_base (8)..(8): base is a locked nucleic acid
  modified_base (10)..(10): base is a locked nucleic acid
tggrmgraayhtgtt

SEQ ID NO: 12440 - DNA, 16 bp, Artificial Sequence
  Oligonucleotide probe
  misc_binding (1)..(16): Hybridization probe for the specific detection of wild-type HIV-1 at codon 88 of the protease gene.
  modified_base (8)..(8): base is a locked nucleic acid
  modified_base (10)..(10): base is a locked nucleic acid
tggrmgraayhtgttg

SEQ ID NO: 12441 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (8)..(8): base is a locked nucleic acid
  modified_base (10)..(10): base is a locked nucleic acid
  modified_base (11)..(11): base is a locked nucleic acid
tggrmgraayhtgtt

SEQ ID NO: 12442 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (8)..(8): base is a locked nucleic acid
  modified_base (10)..(10): base is a locked nucleic acid
  modified_base (14)..(14): base is a locked nucleic acid
tggrmgraayhtgtt

SEQ ID NO: 12443 - DNA, 15 bp, Artificial Sequence
  Oligonucleotide probe
  misc_binding (1)..(15): Hybridization probe for the specific detection of wild-type HIV-1 at codon 88 of the protease gene.
  modified_base (8)..(8): base is a locked nucleic acid
  modified_base (10)..(10): base is a locked nucleic acid
  modified_base (12)..(12): base is a locked nucleic acid
tggrmgraayhtgtt

SEQ ID NO: 12444 - DNA, 15 bp, Artificial Sequence
  Oligonucleotide probe
  misc_binding (1)..(15): Hybridization probe for the specific detection of wild-type HIV-1 at codon 88 of the protease gene.
tggaagaaayctgtt

SEQ ID NO: 12445 - DNA, 20 bp, Artificial Sequence
  Oligonucleotide probe
  misc_binding (1)..(20): Hybridization probe for the specific detection of wild-type HIV-1 at codon 88 of the protease gene.
ttggrmgraayhtgttgacy

SEQ ID NO: 12446 - DNA, 19 bp, Artificial Sequence
  Oligonucleotide probe
  misc_binding (1)..(19): Hybridization probe for the specific detection of wild-type HIV-1 at codon 88 of the protease gene.
ttggrmgraayhtgttgac

SEQ ID NO: 12447 - DNA, 17 bp, Artificial Sequence
  Oligonucleotide probe
  misc_binding (1)..(17): Hybridization probe for the specific detection of wild-type HIV-1 at codon 88 of the protease gene.
tggrmgraayhtgttga

SEQ ID NO: 12448 - DNA, 15 bp, Artificial Sequence
  Oligonucleotide probe
  misc_binding (1)..(15): Hybridization probe for the specific detection of wild-type HIV-1 at codon 88 of the protease gene.
tggrmgraayhtgtt

SEQ ID NO: 12449 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (2)..(2): base is a locked nucleic acid
ggrmgraayytgttgacyca

SEQ ID NO: 12450 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (3)..(3): base is a locked nucleic acid
ggrmgraayytgttgacyca

SEQ ID NO: 12451 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (9)..(9): base is a locked nucleic acid
ggrmgraayytgttgacyca

SEQ ID NO: 12452 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (4)..(4): base is a locked nucleic acid
ggrmgraayytgttgacyca

SEQ ID NO: 12453 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (19)..(19): base is a locked nucleic acid
ggrmgraayytgttgacyca

SEQ ID NO: 12454 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (15)..(15): base is a locked nucleic acid
ggrmgraayytgttgacyca

SEQ ID NO: 12455 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (14)..(14): base is a locked nucleic acid
ggrmgraayytgttgacyca

SEQ ID NO: 12456 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (16)..(16): base is a locked nucleic acid
ggrmgraayytgttgacyca

SEQ ID NO: 12457 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (3)..(3): base is a locked nucleic acid
  modified_base (9)..(9): base is a locked nucleic acid
  modified_base (11)..(11): base is a locked nucleic acid
ggrmgraayytgttgacyca

SEQ ID NO: 12458 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (4)..(4): base is a locked nucleic acid
  modified_base (9)..(9): base is a locked nucleic acid
  modified_base (11)..(11): base is a locked nucleic acid
ggrmgraayytgttgacyca

SEQ ID NO: 12459 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (8)..(8): base is a locked nucleic acid
  modified_base (9)..(9): base is a locked nucleic acid
  modified_base (11)..(11): base is a locked nucleic acid
ggrmgraayytgttgacyca

SEQ ID NO: 12460 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (6)..(6): base is a locked nucleic acid
  modified_base (9)..(9): base is a locked nucleic acid
  modified_base (11)..(11): base is a locked nucleic acid
ggrmgraayytgttgacyca

SEQ ID NO: 12461 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (16)..(16): base is a locked nucleic acid
ggrmgraayytgttgacyca

SEQ ID NO: 12462 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (12)..(12): base is a locked nucleic acid
ggrmgraayytgttgacyca

SEQ ID NO: 12463 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (15)..(15): base is a locked nucleic acid
ggrmgraayytgttgacyca

SEQ ID NO: 12464 - DNA, 20 bp, Artificial Sequence
  Oligonucleotide probe
  misc_binding (1)..(20): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (19)..(19): base is a locked nucleic acid
ggrmgraayytgttgacyca

SEQ ID NO: 12465 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (2)..(2): base is a locked nucleic acid
ggrmgraayytgttgacyc

SEQ ID NO: 12466 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (3)..(3): base is a locked nucleic acid
ggrmgraayytgttgacyc

SEQ ID NO: 12467 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (9)..(9): base is a locked nucleic acid
ggrmgraayytgttgacyc

SEQ ID NO: 12468 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (4)..(4): base is a locked nucleic acid
ggrmgraayytgttgacyc

SEQ ID NO: 12469 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (19)..(19): base is a locked nucleic acid
ggrmgraayytgttgacyc

SEQ ID NO: 12470 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (15)..(15): base is a locked nucleic acid
ggrmgraayytgttgacyc

SEQ ID NO: 12471 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (14)..(14): base is a locked nucleic acid
ggrmgraayytgttgacyc

SEQ ID NO: 12472 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (16)..(16): base is a locked nucleic acid
ggrmgraayytgttgacyc

SEQ ID NO: 12473 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (3)..(3): base is a locked nucleic acid
  modified_base (9)..(9): base is a locked nucleic acid
  modified_base (11)..(11): base is a locked nucleic acid
ggrmgraayytgttgacyc

SEQ ID NO: 12474 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (4)..(4): base is a locked nucleic acid
  modified_base (9)..(9): base is a locked nucleic acid
  modified_base (11)..(11): base is a locked nucleic acid
ggrmgraayytgttgacyc

SEQ ID NO: 12475 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (8)..(8): base is a locked nucleic acid
  modified_base (9)..(9): base is a locked nucleic acid
  modified_base (11)..(11): base is a locked nucleic acid
ggrmgraayytgttgacyc

SEQ ID NO: 12476 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (6)..(6): base is a locked nucleic acid
  modified_base (9)..(9): base is a locked nucleic acid
  modified_base (11)..(11): base is a locked nucleic acid
ggrmgraayytgttgacyc

SEQ ID NO: 12477 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (16)..(16): base is a locked nucleic acid
ggrmgraayytgttgacyc

SEQ ID NO: 12478 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (12)..(12): base is a locked nucleic acid
ggrmgraayytgttgacyc

SEQ ID NO: 12479 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (15)..(15): base is a locked nucleic acid
ggrmgraayytgttgacyc

SEQ ID NO: 12480 - DNA, 19 bp, Artificial Sequence
  Oligonucleotide probe
  misc_binding (1)..(19): Hybridization probe for the specific detection of wild-type HIV-1 at codon 89 of the protease gene.
  modified_base (9)..(9): base is a locked nucleic acid
  modified_base (11)..(11): base is a locked nucleic acid
  modified_base (19)..(19): base is a locked nucleic acid
ggrmgraayytgttgacyc

SEQ ID NO: 12481 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (1)..(1): base is a locked nucleic acid
grmgraayytgttgacy

SEQ ID NO: 12482 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (2)..(2): base is a locked nucleic acid
grmgraayytgttgacy

SEQ ID NO: 12483 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (8)..(8): base is a locked nucleic acid
grmgraayytgttgacy

SEQ ID NO: 12484 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (3)..(3): base is a locked nucleic acid
grmgraayytgttgacy

SEQ ID NO: 12485 - DNA, 17 bp, Artificial Sequence
  Oligonucleotide probe
  misc_binding (1)..(17): Hybridization probe for the specific detection of wild-type HIV-1 at codon 89 of the protease gene.
grmgraayytgttgacy

SEQ ID NO: 12486 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (14)..(14): base is a locked nucleic acid
grmgraayytgttgacy

SEQ ID NO: 12487 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (13)..(13): base is a locked nucleic acid
grmgraayytgttgacy

SEQ ID NO: 12488 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (15)..(15): base is a locked nucleic acid
grmgraayytgttgacy

SEQ ID NO: 12489 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (2)..(2): base is a locked nucleic acid
  modified_base (8)..(8): base is a locked nucleic acid
  modified_base (10)..(10): base is a locked nucleic acid
grmgraayytgttgacy

SEQ ID NO: 12490 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (3)..(3): base is a locked nucleic acid
  modified_base (8)..(8): base is a locked nucleic acid
  modified_base (10)..(10): base is a locked nucleic acid
grmgraayytgttgacy

SEQ ID NO: 12491 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (7)..(7): base is a locked nucleic acid
  modified_base (8)..(8): base is a locked nucleic acid
  modified_base (10)..(10): base is a locked nucleic acid
grmgraayytgttgacy

SEQ ID NO: 12492 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (5)..(5): base is a locked nucleic acid
  modified_base (8)..(8): base is a locked nucleic acid
  modified_base (10)..(10): base is a locked nucleic acid
grmgraayytgttgacy

SEQ ID NO: 12493 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (8)..(8): base is a locked nucleic acid
  modified_base (10)..(10): base is a locked nucleic acid
  modified_base (15)..(15): base is a locked nucleic acid
grmgraayytgttgacy

SEQ ID NO: 12494 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (8)..(8): base is a locked nucleic acid
  modified_base (10)..(10): base is a locked nucleic acid
  modified_base (11)..(11): base is a locked nucleic acid
grmgraayytgttgacy

SEQ ID NO: 12495 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (8)..(8): base is a locked nucleic acid
  modified_base (10)..(10): base is a locked nucleic acid
  modified_base (14)..(14): base is a locked nucleic acid
grmgraayytgttgacy

SEQ ID NO: 12496 - DNA, 17 bp, Artificial Sequence
  Oligonucleotide probe
  misc_binding (1)..(17): Hybridization probe for the specific detection of wild-type HIV-1 at codon 89 of the protease gene.
  modified_base (8)..(8): base is a locked nucleic acid
  modified_base (10)..(10): base is a locked nucleic acid
grmgraayytgttgacy

SEQ ID NO: 12497 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (1)..(1): base is a locked nucleic acid
grmgraayytgttga

SEQ ID NO: 12498 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (2)..(2): base is a locked nucleic acid
grmgraayytgttga

SEQ ID NO: 12499 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (8)..(8): base is a locked nucleic acid
grmgraayytgttga

SEQ ID NO: 12500 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (3)..(3): base is a locked nucleic acid
grmgraayytgttga

SEQ ID NO: 12501 - DNA, 16 bp, Artificial Sequence
  Oligonucleotide probe
  misc_binding (1)..(16): Hybridization probe for the specific detection of wild-type HIV-1 at codon 89 of the protease gene.
grmgraayytgttgac

SEQ ID NO: 12502 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (14)..(14): base is a locked nucleic acid
grmgraayytgttga

SEQ ID NO: 12503 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (13)..(13): base is a locked nucleic acid
grmgraayytgttga

SEQ ID NO: 12504 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (15)..(15): base is a locked nucleic acid
grmgraayytgttga

SEQ ID NO: 12505 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (2)..(2): base is a locked nucleic acid
  modified_base (8)..(8): base is a locked nucleic acid
  modified_base (10)..(10): base is a locked nucleic acid
grmgraayytgttga

SEQ ID NO: 12506 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (3)..(3): base is a locked nucleic acid
  modified_base (8)..(8): base is a locked nucleic acid
  modified_base (10)..(10): base is a locked nucleic acid
grmgraayytgttga

SEQ ID NO: 12507 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (7)..(7): base is a locked nucleic acid
  modified_base (8)..(8): base is a locked nucleic acid
  modified_base (10)..(10): base is a locked nucleic acid
grmgraayytgttga

SEQ ID NO: 12508 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (5)..(5): base is a locked nucleic acid
  modified_base (8)..(8): base is a locked nucleic acid
  modified_base (10)..(10): base is a locked nucleic acid
grmgraayytgttga

SEQ ID NO: 12509 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (8)..(8): base is a locked nucleic acid
  modified_base (10)..(10): base is a locked nucleic acid
  modified_base (15)..(15): base is a locked nucleic acid
grmgraayytgttga

SEQ ID NO: 12510 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (8)..(8): base is a locked nucleic acid
  modified_base (10)..(10): base is a locked nucleic acid
  modified_base (11)..(11): base is a locked nucleic acid
grmgraayytgttga

SEQ ID NO: 12511 - DNA, 15 bp, Artificial Sequence
  Oligonucleotide probe
  misc_binding (1)..(15): Hybridization probe for the specific detection of wild-type HIV-1 at codon 89 of the protease gene.
  modified_base (8)..(8): base is a locked nucleic acid
  modified_base (10)..(10): base is a locked nucleic acid
  modified_base (14)..(14): base is a locked nucleic acid
grmgraayytgttga

SEQ ID NO: 12512 - DNA, 16 bp, Artificial Sequence
  Oligonucleotide probe
  misc_binding (1)..(16): Hybridization probe for the specific detection of wild-type HIV-1 at codon 89 of the protease gene.
  modified_base (8)..(8): base is a locked nucleic acid
  modified_base (10)..(10): base is a locked nucleic acid
grmgraayytgttgac

SEQ ID NO: 12513 - DNA, 15 bp, Artificial Sequence
  Oligonucleotide probe
  misc_binding (1)..(15): Hybridization probe for the specific detection of wild-type HIV-1 at codon 89 of the protease gene.
aagaaatytrttgac

SEQ ID NO: 12514 - DNA, 20 bp, Artificial Sequence
  Oligonucleotide probe
  misc_binding (1)..(20): Hybridization probe for the specific detection of wild-type HIV-1 at codon 89 of the protease gene.
ggrmgraayytgttgacyca

SEQ ID NO: 12515 - DNA, 19 bp, Artificial Sequence
  Oligonucleotide probe
  misc_binding (1)..(19): Hybridization probe for the specific detection of wild-type HIV-1 at codon 89 of the protease gene.
ggrmgraayytgttgacyc

SEQ ID NO: 12516 - DNA, 17 bp, Artificial Sequence
  Oligonucleotide probe
  misc_binding (1)..(17): Hybridization probe for the specific detection of wild-type HIV-1 at codon 89 of the protease gene.
grmgraayytgttgacy

SEQ ID NO: 12517 - DNA, 15 bp, Artificial Sequence
  Oligonucleotide probe
  misc_binding (1)..(15): Hybridization probe for the specific detection of wild-type HIV-1 at codon 89 of the protease gene.
grmgraayytgttga

SEQ ID NO: 12518 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (6)..(6): base is a locked nucleic acid
mgraayhtgytgacycarmt

SEQ ID NO: 12519 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (8)..(8): base is a locked nucleic acid
mgraayhtgytgacycarmt

SEQ ID NO: 12520 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (5)..(5): base is a locked nucleic acid
mgraayhtgytgacycarmt

SEQ ID NO: 12521 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (4)..(4): base is a locked nucleic acid
mgraayhtgytgacycarmt

SEQ ID NO: 12522 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (17)..(17): base is a locked nucleic acid
mgraayhtgytgacycarmt

SEQ ID NO: 12523 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (11)..(11): base is a locked nucleic acid
mgraayhtgytgacycarmt

SEQ ID NO: 12524 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (16)..(16): base is a locked nucleic acid
mgraayhtgytgacycarmt

SEQ ID NO: 12525 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (15)..(15): base is a locked nucleic acid
mgraayhtgytgacycarmt

SEQ ID NO: 12526 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (5)..(5): base is a locked nucleic acid
  modified_base (9)..(9): base is a locked nucleic acid
  modified_base (11)..(11): base is a locked nucleic acid
mgraayhtgytgacycarmt

SEQ ID NO: 12527 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (2)..(2): base is a locked nucleic acid
  modified_base (9)..(9): base is a locked nucleic acid
  modified_base (11)..(11): base is a locked nucleic acid
mgraayhtgytgacycarmt

SEQ ID NO: 12528 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (3)..(3): base is a locked nucleic acid
  modified_base (9)..(9): base is a locked nucleic acid
  modified_base (11)..(11): base is a locked nucleic acid
mgraayhtgytgacycarmt

SEQ ID NO: 12529 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (6)..(6): base is a locked nucleic acid
  modified_base (9)..(9): base is a locked nucleic acid
  modified_base (11)..(11): base is a locked nucleic acid
mgraayhtgytgacycarmt

SEQ ID NO: 12530 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (18)..(18): base is a locked nucleic acid
mgraayhtgytgacycarmt

SEQ ID NO: 12531 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (12)..(12): base is a locked nucleic acid
mgraayhtgytgacycarmt

SEQ ID NO: 12532 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (15)..(15): base is a locked nucleic acid
mgraayhtgytgacycarmt

SEQ ID NO: 12533 - DNA, 20 bp, Artificial Sequence
  Oligonucleotide probe
  misc_binding (1)..(20): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (17)..(17): base is a locked nucleic acid
mgraayhtgytgacycarmt

SEQ ID NO: 12534 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (6)..(6): base is a locked nucleic acid
mgraayhtgytgacycarm

SEQ ID NO: 12535 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (8)..(8): base is a locked nucleic acid
mgraayhtgytgacycarm

SEQ ID NO: 12536 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (5)..(5): base is a locked nucleic acid
mgraayhtgytgacycarm

SEQ ID NO: 12537 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (4)..(4): base is a locked nucleic acid
mgraayhtgytgacycarm

SEQ ID NO: 12538 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (17)..(17): base is a locked nucleic acid
mgraayhtgytgacycarm

SEQ ID NO: 12539 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (11)..(11): base is a locked nucleic acid
mgraayhtgytgacycarm

SEQ ID NO: 12540 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (16)..(16): base is a locked nucleic acid
mgraayhtgytgacycarm

SEQ ID NO: 12541 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (15)..(15): base is a locked nucleic acid
mgraayhtgytgacycarm

SEQ ID NO: 12542 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (5)..(5): base is a locked nucleic acid
  modified_base (9)..(9): base is a locked nucleic acid
  modified_base (11)..(11): base is a locked nucleic acid
mgraayhtgytgacycarm

SEQ ID NO: 12543 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (2)..(2): base is a locked nucleic acid
  modified_base (9)..(9): base is a locked nucleic acid
  modified_base (11)..(11): base is a locked nucleic acid
mgraayhtgytgacycarm

SEQ ID NO: 12544 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (3)..(3): base is a locked nucleic acid
  modified_base (9)..(9): base is a locked nucleic acid
  modified_base (11)..(11): base is a locked nucleic acid
mgraayhtgytgacycarm

SEQ ID NO: 12545 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (6)..(6): base is a locked nucleic acid
  modified_base (9)..(9): base is a locked nucleic acid
  modified_base (11)..(11): base is a locked nucleic acid
mgraayhtgytgacycarm

SEQ ID NO: 12546 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (18)..(18): base is a locked nucleic acid
mgraayhtgytgacycarm

SEQ ID NO: 12547 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (12)..(12): base is a locked nucleic acid
mgraayhtgytgacycarm

SEQ ID NO: 12548 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (15)..(15): base is a locked nucleic acid
mgraayhtgytgacycarm

SEQ ID NO: 12549 - DNA, 19 bp, Artificial Sequence
  Oligonucleotide probe
  misc_binding (1)..(19): Hybridization probe for the specific detection of wild-type HIV-1 at codon 90 of the protease gene.
  modified_base (9)..(9): base is a locked nucleic acid
  modified_base (11)..(11): base is a locked nucleic acid
  modified_base (17)..(17): base is a locked nucleic acid
mgraayhtgytgacycarm

SEQ ID NO: 12550 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (5)..(5): base is a locked nucleic acid
graayhtgytgacycar

SEQ ID NO: 12551 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (7)..(7): base is a locked nucleic acid
graayhtgytgacycar

SEQ ID NO: 12552 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (4)..(4): base is a locked nucleic acid
graayhtgytgacycar

SEQ ID NO: 12553 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (3)..(3): base is a locked nucleic acid
graayhtgytgacycar

SEQ ID NO: 12554 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (16)..(16): base is a locked nucleic acid
graayhtgytgacycar

SEQ ID NO: 12555 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (10)..(10): base is a locked nucleic acid
graayhtgytgacycar

SEQ ID NO: 12556 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (15)..(15): base is a locked nucleic acid
graayhtgytgacycar

SEQ ID NO: 12557 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (14)..(14): base is a locked nucleic acid
graayhtgytgacycar

SEQ ID NO: 12558 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (4)..(4): base is a locked nucleic acid
  modified_base (8)..(8): base is a locked nucleic acid
  modified_base (10)..(10): base is a locked nucleic acid
graayhtgytgacycar

SEQ ID NO: 12559 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (1)..(1): base is a locked nucleic acid
  modified_base (8)..(8): base is a locked nucleic acid
  modified_base (10)..(10): base is a locked nucleic acid
graayhtgytgacycar

SEQ ID NO: 12560 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (2)..(2): base is a locked nucleic acid
  modified_base (8)..(8): base is a locked nucleic acid
  modified_base (10)..(10): base is a locked nucleic acid
graayhtgytgacycar

SEQ ID NO: 12561 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (5)..(5): base is a locked nucleic acid
  modified_base (8)..(8): base is a locked nucleic acid
  modified_base (10)..(10): base is a locked nucleic acid
graayhtgytgacycar

SEQ ID NO: 12562 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (8)..(8): base is a locked nucleic acid
  modified_base (10)..(10): base is a locked nucleic acid
  modified_base (17)..(17): base is a locked nucleic acid
graayhtgytgacycar

SEQ ID NO: 12563 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (8)..(8): base is a locked nucleic acid
  modified_base (10)..(10): base is a locked nucleic acid
  modified_base (11)..(11): base is a locked nucleic acid
graayhtgytgacycar

SEQ ID NO: 12564 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (8)..(8): base is a locked nucleic acid
  modified_base (10)..(10): base is a locked nucleic acid
  modified_base (14)..(14): base is a locked nucleic acid
graayhtgytgacycar

SEQ ID NO: 12565 - DNA, 17 bp, Artificial Sequence
  Oligonucleotide probe
  misc_binding (1)..(17): Hybridization probe for the specific detection of wild-type HIV-1 at codon 90 of the protease gene.
  modified_base (8)..(8): base is a locked nucleic acid
  modified_base (10)..(10): base is a locked nucleic acid
  modified_base (16)..(16): base is a locked nucleic acid
graayhtgytgacycar

SEQ ID NO: 12566 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (5)..(5): base is a locked nucleic acid
graayhtgytgacyc

SEQ ID NO: 12567 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (7)..(7): base is a locked nucleic acid
graayhtgytgacyc

SEQ ID NO: 12568 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (4)..(4): base is a locked nucleic acid
graayhtgytgacyc

SEQ ID NO: 12569 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (3)..(3): base is a locked nucleic acid
graayhtgytgacyc

SEQ ID NO: 12570 - DNA, 15 bp, Artificial Sequence
  Oligonucleotide probe
  misc_binding (1)..(15): Hybridization probe for the specific detection of wild-type HIV-1 at codon 90 of the protease gene.
graayhtgytgacyc

SEQ ID NO: 12571 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (10)..(10): base is a locked nucleic acid
graayhtgytgacyc

SEQ ID NO: 12572 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (15)..(15): base is a locked nucleic acid
graayhtgytgacyc

SEQ ID NO: 12573 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (14)..(14): base is a locked nucleic acid
graayhtgytgacyc

SEQ ID NO: 12574 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (4)..(4): base is a locked nucleic acid
  modified_base (8)..(8): base is a locked nucleic acid
  modified_base (10)..(10): base is a locked nucleic acid
graayhtgytgacyc

SEQ ID NO: 12575 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (1)..(1): base is a locked nucleic acid
  modified_base (8)..(8): base is a locked nucleic acid
  modified_base (10)..(10): base is a locked nucleic acid
graayhtgytgacyc

SEQ ID NO: 12576 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (2)..(2): base is a locked nucleic acid
  modified_base (8)..(8): base is a locked nucleic acid
  modified_base (10)..(10): base is a locked nucleic acid
graayhtgytgacyc

SEQ ID NO: 12577 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (5)..(5): base is a locked nucleic acid
  modified_base (8)..(8): base is a locked nucleic acid
  modified_base (10)..(10): base is a locked nucleic acid
graayhtgytgacyc

SEQ ID NO: 12578 - DNA, 16 bp, Artificial Sequence
  Oligonucleotide probe
  misc_binding (1)..(16): Hybridization probe for the specific detection of wild-type HIV-1 at codon 90 of the protease gene.
  modified_base (8)..(8): base is a locked nucleic acid
  modified_base (10)..(10): base is a locked nucleic acid
graayhtgytgacyca

SEQ ID NO: 12579 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (8)..(8): base is a locked nucleic acid
  modified_base (10)..(10): base is a locked nucleic acid
  modified_base (11)..(11): base is a locked nucleic acid
graayhtgytgacyc

SEQ ID NO: 12580 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (8)..(8): base is a locked nucleic acid
  modified_base (10)..(10): base is a locked nucleic acid
  modified_base (14)..(14): base is a locked nucleic acid
graayhtgytgacyc

SEQ ID NO: 12581 - DNA, 15 bp, Artificial Sequence
  Oligonucleotide probe
  misc_binding (1)..(15): Hybridization probe for the specific detection of wild-type HIV-1 at codon 90 of the protease gene.
  modified_base (8)..(8): base is a locked nucleic acid
  modified_base (10)..(10): base is a locked nucleic acid
graayhtgytgacyc

SEQ ID NO: 12582 - DNA, 15 bp, Artificial Sequence
  Oligonucleotide probe
  misc_binding (1)..(15): Hybridization probe for the specific detection of wild-type HIV-1 at codon 90 of the protease gene.
aaatctgytractca

SEQ ID NO: 12583 - DNA, 20 bp, Artificial Sequence
  Oligonucleotide probe
  misc_binding (1)..(20): Hybridization probe for the specific detection of wild-type HIV-1 at codon 90 of the protease gene.
mgraayhtgytgacycarmt

SEQ ID NO: 12584 - DNA, 19 bp, Artificial Sequence
  Oligonucleotide probe
  misc_binding (1)..(19): Hybridization probe for the specific detection of wild-type HIV-1 at codon 90 of the protease gene.
mgraayhtgytgacycarm

SEQ ID NO: 12585 - DNA, 17 bp, Artificial Sequence
  Oligonucleotide probe
  misc_binding (1)..(17): Hybridization probe for the specific detection of wild-type HIV-1 at codon 90 of the protease gene.
graayhtgytgacycar

SEQ ID NO: 12586 - DNA, 15 bp, Artificial Sequence
  Oligonucleotide probe
  misc_binding (1)..(15): Hybridization probe for the specific detection of wild-type HIV-1 at codon 90 of the protease gene.
graayhtgytgacyc

SEQ ID NO: 12587 - DNA, 16 bp, Artificial Sequence
  Oligonucleotide probe
  misc_binding (1)..(16): Hybridization probe for the specific detection of wild-type HIV-1 at codon 90 of the protease gene.
graayhtgytgacyca

SEQ ID NO: 12588 - DNA, 15 bp, Artificial Sequence
  Oligonucleotide probe
  misc_binding (1)..(15): Hybridization probe for the specific detection of mutant HIV-1 at codon 10 of the protease gene.
cgacccttygtcaca

SEQ ID NO: 12589 - DNA, 15 bp, Artificial Sequence
  Oligonucleotide probe
  misc_binding (1)..(15): Hybridization probe for the specific detection of mutant HIV-1 at codon 10 of the protease gene.
cgaccccghgtcaca

SEQ ID NO: 12590 - DNA, 15 bp, Artificial Sequence
  Oligonucleotide probe
  misc_binding (1)..(15): Hybridization probe for the specific detection of mutant HIV-1 at codon 10 of the protease gene.
cgacccagagtcaca

SEQ ID NO: 12591 - DNA, 15 bp, Artificial Sequence
  Oligonucleotide probe
  misc_binding (1)..(15): Hybridization probe for the specific detection of mutant HIV-1 at codon 10 of the protease gene.
cgaccctaygtcaca

SEQ ID NO: 12592 - DNA, 15 bp, Artificial Sequence
  Oligonucleotide probe
  misc_binding (1)..(15): Hybridization probe for the specific detection of mutant HIV-1 at codon 11 of the protease gene.
cccctcatyacaata

SEQ ID NO: 12593 - DNA, 15 bp, Artificial Sequence
  Oligonucleotide probe
  misc_binding (1)..(15): Hybridization probe for the specific detection of mutant HIV-1 at codon 11 of the protease gene.
cccctcctyacaata

SEQ ID NO: 12594 - DNA, 15 bp, Artificial Sequence
  Oligonucleotide probe
  misc_binding (1)..(15): Hybridization probe for the specific detection of mutant HIV-1 at codon 20 of the protease gene.
caactaacrgaagct

SEQ ID NO: 12595 - DNA, 15 bp, Artificial Sequence
  Oligonucleotide probe
  misc_binding (1)..(15): Hybridization probe for the specific detection of mutant HIV-1 at codon 20 of the protease gene.
caactagtrgaagct

SEQ ID NO: 12596 - DNA, 15 bp, Artificial Sequence
  Oligonucleotide probe
  misc_binding (1)..(15): Hybridization probe for the specific detection of mutant HIV-1 at codon 23 of the protease gene.
tatctadatgagctt

SEQ ID NO: 12597 - DNA, 15 bp, Artificial Sequence
  Oligonucleotide probe
  misc_binding (1)..(15): Hybridization probe for the specific detection of mutant HIV-1 at codon 24 of the protease gene.
tgtatctattagagc

SEQ ID NO: 12598 - DNA, 15 bp, Artificial Sequence
  Oligonucleotide probe
  misc_binding (1)..(15): Hybridization probe for the specific detection of mutant HIV-1 at codon 24 of the protease gene.
tgtatctaatagagc

SEQ ID NO: 12599 - DNA, 15 bp, Artificial Sequence
  Oligonucleotide probe
  misc_binding (1)..(15): Hybridization probe for the specific detection of mutant HIV-1 at codon 30 of the protease gene.
tactgtrttatctgc

SEQ ID NO: 12600 - DNA, 15 bp, Artificial Sequence
  Oligonucleotide probe
  misc_binding (1)..(15): Hybridization probe for the specific detection of mutant HIV-1 at codon 32 of the protease gene.
ttctaatattgtatc

SEQ ID NO: 12601 - DNA, 15 bp, Artificial Sequence
  Oligonucleotide probe
  misc_binding (1)..(15): Hybridization probe for the specific detection of mutant HIV-1 at codon 33 of the protease gene.
acagtattygaagaa

SEQ ID NO: 12602 - DNA, 15 bp, Artificial Sequence
  Oligonucleotide probe
  misc_binding (1)..(15): Hybridization probe for the specific detection of mutant HIV-1 at codon 43 of the protease gene.
aaatggacrccaaaa

SEQ ID NO: 12603 - DNA, 15 bp, Artificial Sequence
  Oligonucleotide probe
  misc_binding (1)..(15): Hybridization probe for the specific detection of mutant HIV-1 at codon 46 of the protease gene.
ccaaaaathataggg

SEQ ID NO: 12604 - DNA, 15 bp, Artificial Sequence
  Oligonucleotide probe
  misc_binding (1)..(15): Hybridization probe for the specific detection of mutant HIV-1 at codon 46 of the protease gene.
ccaaaaytgataggg

SEQ ID NO: 12605 - DNA, 15 bp, Artificial Sequence
  Oligonucleotide probe
  misc_binding (1)..(15): Hybridization probe for the specific detection of mutant HIV-1 at codon 46 of the protease gene.
ccaaaagtgataggg

SEQ ID NO: 12606 - DNA, 19 bp, Artificial Sequence
  Oligonucleotide probe
  misc_binding (1)..(19): Hybridization probe for the specific detection of mutant HIV-1 at codon 47 of the protease gene.
  modified_base (9)..(9): base is a locked nucleic acid
  modified_base (10)..(10): base is a locked nucleic acid
ccaaraatgtaggrggaat

SEQ ID NO: 12607 - DNA, 19 bp, Artificial Sequence
  Oligonucleotide probe
  misc_binding (1)..(19): Hybridization probe for the specific detection of mutant HIV-1 at codon 47 of the protease gene.
  modified_base (5)..(5): base is a locked nucleic acid
ccaaraatgtaggrggaat

SEQ ID NO: 12608 - DNA, 19 bp, Artificial Sequence
  Oligonucleotide probe
  misc_binding (1)..(19): Hybridization probe for the specific detection of mutant HIV-1 at codon 47 of the protease gene.
  modified_base (9)..(9): base is a locked nucleic acid
ccaaraatgtaggrggaat

SEQ ID NO: 12609 - DNA, 19 bp, Artificial Sequence
  Oligonucleotide probe
  misc_binding (1)..(19): Hybridization probe for the specific detection of mutant HIV-1 at codon 47 of the protease gene.
  modified_base (3)..(3): base is a locked nucleic acid
ccaaraatgtaggrggaat

SEQ ID NO: 12610 - DNA, 19 bp, Artificial Sequence
  Oligonucleotide probe
  misc_binding (1)..(19): Hybridization probe for the specific detection of mutant HIV-1 at codon 47 of the protease gene.
  modified_base (8)..(8): base is a locked nucleic acid
ccaaraatgtaggrggaat

SEQ ID NO: 12611 - DNA, 19 bp, Artificial Sequence
  Oligonucleotide probe
  misc_binding (1)..(19): Hybridization probe for the specific detection of mutant HIV-1 at codon 47 of the protease gene.
  modified_base (14)..(14): base is a locked nucleic acid
ccaaraatgtaggrggaat

SEQ ID NO: 12612 - DNA, 19 bp, Artificial Sequence
  Oligonucleotide probe
  misc_binding (1)..(19): Hybridization probe for the specific detection of mutant HIV-1 at codon 47 of the protease gene.
  modified_base (15)..(15): base is a locked nucleic acid
ccaaraatgtaggrggaat

SEQ ID NO: 12613 - DNA, 19 bp, Artificial Sequence
  Oligonucleotide probe
  misc_binding (1)..(19): Hybridization probe for the specific detection of mutant HIV-1 at codon 47 of the protease gene.
  modified_base (16)..(16): base is a locked nucleic acid
ccaaraatgtaggrggaat

SEQ ID NO: 12614 - DNA, 19 bp, Artificial Sequence
  Oligonucleotide probe
  misc_binding (1)..(19): Hybridization probe for the specific detection of mutant HIV-1 at codon 47 of the protease gene.
  modified_base (12)..(12): base is a locked nucleic acid
ccaaraatgtaggrggaat

SEQ ID NO: 12615 - DNA, 19 bp, Artificial Sequence
  Oligonucleotide probe
  misc_binding (1)..(19): Hybridization probe for the specific detection of mutant HIV-1 at codon 47 of the protease gene.
  modified_base (4)..(4): base is a locked nucleic acid
  modified_base (9)..(9): base is a locked nucleic acid
  modified_base (10)..(10): base is a locked nucleic acid
ccaaraatgtaggrggaat

SEQ ID NO: 12616 - DNA, 19 bp, Artificial Sequence
  Oligonucleotide probe
  misc_binding (1)..(19): Hybridization probe for the specific detection of mutant HIV-1 at codon 47 of the protease gene.
  modified_base (3)..(3): base is a locked nucleic acid
  modified_base (9)..(9): base is a locked nucleic acid
  modified_base (10)..(10): base is a locked nucleic acid
ccaaraatgtaggrggaat

SEQ ID NO: 12617 - DNA, 19 bp, Artificial Sequence
  Oligonucleotide probe
  misc_binding (1)..(19): Hybridization probe for the specific detection of mutant HIV-1 at codon 47 of the protease gene.
  modified_base (2)..(2): base is a locked nucleic acid
  modified_base (9)..(9): base is a locked nucleic acid
  modified_base (10)..(10): base is a locked nucleic acid
ccaaraatgtaggrggaat

SEQ ID NO: 12618 - DNA, 19 bp, Artificial Sequence
  Oligonucleotide probe
  misc_binding (1)..(19): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (10)..(10): base is a locked nucleic acid
ccaaraatgtaggrggaat

SEQ ID NO: 12619 - DNA, 19 bp, Artificial Sequence
  Oligonucleotide probe
  misc_binding (1)..(19): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (12)..(12): base is a locked nucleic acid
ccaaraatgtaggrggaat

SEQ ID NO: 12620 - DNA, 19 bp, Artificial Sequence
  Oligonucleotide probe
  misc_binding (1)..(19): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (15)..(15): base is a locked nucleic acid
ccaaraatgtaggrggaat

SEQ ID NO: 12621 - DNA, 19 bp, Artificial Sequence
  Oligonucleotide probe
  misc_binding (1)..(19): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (13)..(13): base is a locked nucleic acid
ccaaraatgtaggrggaat

SEQ ID NO: 12622 - DNA, 19 bp, Artificial Sequence
  Oligonucleotide probe
  misc_binding (1)..(19): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (17)..(17): base is a locked nucleic acid
ccaaraatgtaggrggaat

SEQ ID NO: 12623 - DNA, 18 bp, Artificial Sequence
  Oligonucleotide probe
  misc_binding (1)..(18): Hybridization probe for the specific detection of mutant HIV-1 at codon 47 of the protease gene.
  modified_base (9)..(9): base is a locked nucleic acid
  modified_base (10)..(10): base is a locked nucleic acid
ccaaraatgtaggrggaa

SEQ ID NO: 12624 - DNA, 18 bp, Artificial Sequence
  Oligonucleotide probe
  misc_binding (1)..(18): Hybridization probe for the specific detection of mutant HIV-1 at codon 47 of the protease gene.
  modified_base (5)..(5): base is a locked nucleic acid
ccaaraatgtaggrggaa

SEQ ID NO: 12625 - DNA, 18 bp, Artificial Sequence
  Oligonucleotide probe
  misc_binding (1)..(18): Hybridization probe for the specific detection of mutant HIV-1 at codon 47 of the protease gene.
  modified_base (9)..(9): base is a locked nucleic acid
ccaaraatgtaggrggaa

SEQ ID NO: 12626 - DNA, 18 bp, Artificial Sequence
  Oligonucleotide probe
  misc_binding (1)..(18): Hybridization probe for the specific detection of mutant HIV-1 at codon 47 of the protease gene.
  modified_base (3)..(3): base is a locked nucleic acid
ccaaraatgtaggrggaa

SEQ ID NO: 12627 - DNA, 18 bp, Artificial Sequence
  Oligonucleotide probe
  misc_binding (1)..(18): Hybridization probe for the specific detection of mutant HIV-1 at codon 47 of the protease gene.
  modified_base (8)..(8): base is a locked nucleic acid
ccaaraatgtaggrggaa

SEQ ID NO: 12628 - DNA, 18 bp, Artificial Sequence
  Oligonucleotide probe
  misc_binding (1)..(18): Hybridization probe for the specific detection of mutant HIV-1 at codon 47 of the protease gene.
  modified_base (14)..(14): base is a locked nucleic acid
ccaaraatgtaggrggaa

SEQ ID NO: 12629 - DNA, 18 bp, Artificial Sequence
  Oligonucleotide probe
  misc_binding (1)..(18): Hybridization probe for the specific detection of mutant HIV-1 at codon 47 of the protease gene.
  modified_base (15)..(15): base is a locked nucleic acid
ccaaraatgtaggrggaa

SEQ ID NO: 12630 - DNA, 18 bp, Artificial Sequence
  Oligonucleotide probe
  misc_binding (1)..(18): Hybridization probe for the specific detection of mutant HIV-1 at codon 47 of the protease gene.
  modified_base (16)..(16): base is a locked nucleic acid
ccaaraatgtaggrggaa

SEQ ID NO: 12631 - DNA, 18 bp, Artificial Sequence
  Oligonucleotide probe
  misc_binding (1)..(18): Hybridization probe for the specific detection of mutant HIV-1 at codon 47 of the protease gene.
  modified_base (12)..(12): base is a locked nucleic acid
ccaaraatgtaggrggaa

SEQ ID NO: 12632 - DNA, 18 bp, Artificial Sequence
  Oligonucleotide probe
  misc_binding (1)..(18): Hybridization probe for the specific detection of mutant HIV-1 at codon 47 of the protease gene.
  modified_base (4)..(4): base is a locked nucleic acid
  modified_base (9)..(9): base is a locked nucleic acid
  modified_base (10)..(10): base is a locked nucleic acid
ccaaraatgtaggrggaa

SEQ ID NO: 12633 - DNA, 18 bp, Artificial Sequence
  Oligonucleotide probe
  misc_binding (1)..(18): Hybridization probe for the specific detection of mutant HIV-1 at codon 47 of the protease gene.
  modified_base (3)..(3): base is a locked nucleic acid
  modified_base (9)..(9): base is a locked nucleic acid
  modified_base (10)..(10): base is a locked nucleic acid
ccaaraatgtaggrggaa

SEQ ID NO: 12634 - DNA, 18 bp, Artificial Sequence
  Oligonucleotide probe
  misc_binding (1)..(18): Hybridization probe for the specific detection of mutant HIV-1 at codon 47 of the protease gene.
  modified_base (2)..(2): base is a locked nucleic acid
  modified_base (9)..(9): base is a locked nucleic acid
  modified_base (10)..(10): base is a locked nucleic acid
ccaaraatgtaggrggaa

SEQ ID NO: 12635 - DNA, 18 bp, Artificial Sequence
  Oligonucleotide probe
  misc_binding (1)..(18): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (10)..(10): base is a locked nucleic acid
ccaaraatgtaggrggaa

SEQ ID NO: 12636 - DNA, 18 bp, Artificial Sequence
  Oligonucleotide probe
  misc_binding (1)..(18): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (12)..(12): base is a locked nucleic acid
ccaaraatgtaggrggaa

SEQ ID NO: 12637 - DNA, 18 bp, Artificial Sequence
  Oligonucleotide probe
  misc_binding (1)..(18): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (15)..(15): base is a locked nucleic acid
ccaaraatgtaggrggaa

SEQ ID NO: 12638 - DNA, 18 bp, Artificial Sequence
  Oligonucleotide probe
  misc_binding (1)..(18): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (13)..(13): base is a locked nucleic acid
ccaaraatgtaggrggaa

SEQ ID NO: 12639 - DNA, 18 bp, Artificial Sequence
  Oligonucleotide probe
  misc_binding (1)..(18): Hybridization probe for the specific detection of mutant HIV-1 at codon 47 of the protease gene.
  modified_base (9)..(9): base is a locked nucleic acid
  modified_base (10)..(10): base is a locked nucleic acid
  modified_base (17)..(17): base is a locked nucleic acid
ccaaraatgtaggrggaa

SEQ ID NO: 12640 - DNA, 17 bp, Artificial Sequence
  Oligonucleotide probe
  misc_binding (1)..(17): Hybridization probe for the specific detection of mutant HIV-1 at codon 47 of the protease gene.
  modified_base (8)..(8): base is a locked nucleic acid
  modified_base (9)..(9): base is a locked nucleic acid
caaraatgtaggrggaa

SEQ ID NO: 12641 - DNA, 17 bp, Artificial Sequence
  Oligonucleotide probe
  misc_binding (1)..(17): Hybridization probe for the specific detection of mutant HIV-1 at codon 47 of the protease gene.
  modified_base (4)..(4): base is a locked nucleic acid
caaraatgtaggrggaa

SEQ ID NO: 12642 - DNA, 17 bp, Artificial Sequence
  Oligonucleotide probe
  misc_binding (1)..(17): Hybridization probe for the specific detection of mutant HIV-1 at codon 47 of the protease gene.
  modified_base (8)..(8): base is a locked nucleic acid
caaraatgtaggrggaa

SEQ ID NO: 12643 - DNA, 17 bp, Artificial Sequence
  Oligonucleotide probe
  misc_binding (1)..(17): Hybridization probe for the specific detection of mutant HIV-1 at codon 47 of the protease gene.
  modified_base (2)..(2): base is a locked nucleic acid
caaraatgtaggrggaa

SEQ ID NO: 12644 - DNA, 17 bp, Artificial Sequence
  Oligonucleotide probe
  misc_binding (1)..(17): Hybridization probe for the specific detection of mutant HIV-1 at codon 47 of the protease gene.
  modified_base (7)..(7): base is a locked nucleic acid
caaraatgtaggrggaa

SEQ ID NO: 12645 - DNA, 17 bp, Artificial Sequence
  Oligonucleotide probe
  misc_binding (1)..(17): Hybridization probe for the specific detection of mutant HIV-1 at codon 47 of the protease gene.
  modified_base (13)..(13): base is a locked nucleic acid
caaraatgtaggrggaa

SEQ ID NO: 12646 - DNA, 17 bp, Artificial Sequence
  Oligonucleotide probe
  misc_binding (1)..(17): Hybridization probe for the specific detection of mutant HIV-1 at codon 47 of the protease gene.
  modified_base (14)..(14): base is a locked nucleic acid
caaraatgtaggrggaa

SEQ ID NO: 12647 - DNA, 17 bp, Artificial Sequence
  Oligonucleotide probe
  misc_binding (1)..(17): Hybridization probe for the specific detection of mutant HIV-1 at codon 47 of the protease gene.
  modified_base (15)..(15): base is a locked nucleic acid
caaraatgtaggrggaa

SEQ ID NO: 12648 - DNA, 17 bp, Artificial Sequence
  Oligonucleotide probe
  misc_binding (1)..(17): Hybridization probe for the specific detection of mutant HIV-1 at codon 47 of the protease gene.
  modified_base (11)..(11): base is a locked nucleic acid
caaraatgtaggrggaa

SEQ ID NO: 12649 - DNA, 17 bp, Artificial Sequence
  Oligonucleotide probe
  misc_binding (1)..(17): Hybridization probe for the specific detection of mutant HIV-1 at codon 47 of the protease gene.
  modified_base (3)..(3): base is a locked nucleic acid
  modified_base (8)..(8): base is a locked nucleic acid
  modified_base (9)..(9): base is a locked nucleic acid
caaraatgtaggrggaa

SEQ ID NO: 12650 - DNA, 17 bp, Artificial Sequence
  Oligonucleotide probe
  misc_binding (1)..(17): Hybridization probe for the specific detection of mutant HIV-1 at codon 47 of the protease gene.
  modified_base (2)..(2): base is a locked nucleic acid
  modified_base (8)..(8): base is a locked nucleic acid
  modified_base (9)..(9): base is a locked nucleic acid
caaraatgtaggrggaa

SEQ ID NO: 12651 - DNA, 17 bp, Artificial Sequence
  Oligonucleotide probe
  misc_binding (1)..(17): Hybridization probe for the specific detection of mutant HIV-1 at codon 47 of the protease gene.
  modified_base (1)..(1): base is a locked nucleic acid
  modified_base (8)..(8): base is a locked nucleic acid
  modified_base (9)..(9): base is a locked nucleic acid
caaraatgtaggrggaa

SEQ ID NO: 12652 - DNA, 17 bp, Artificial Sequence
  Oligonucleotide probe
  misc_binding (1)..(17): Hybridization probe for the specific detection of mutant HIV-1 at codon 47 of the protease gene.
  modified_base (7)..(7): base is a locked nucleic acid
  modified_base (8)..(8): base is a locked nucleic acid
  modified_base (9)..(9): base is a locked nucleic acid
caaraatgtaggrggaa

SEQ ID NO: 12653 - DNA, 17 bp, Artificial Sequence
  Oligonucleotide probe
  misc_binding (1)..(17): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (11)..(11): base is a locked nucleic acid
caaraatgtaggrggaa

SEQ ID NO: 12654 - DNA, 17 bp, Artificial Sequence
  Oligonucleotide probe
  misc_binding (1)..(17): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (14)..(14): base is a locked nucleic acid
caaraatgtaggrggaa

SEQ ID NO: 12655 - DNA, 17 bp, Artificial Sequence
  Oligonucleotide probe
  misc_binding (1)..(17): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (12)..(12): base is a locked nucleic acid
caaraatgtaggrggaa

SEQ ID NO: 12656 - DNA, 17 bp, Artificial Sequence
  Oligonucleotide probe
  misc_binding (1)..(17): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (16)..(16): base is a locked nucleic acid
caaraatgtaggrggaa

SEQ ID NO: 12657 - DNA, 15 bp, Artificial Sequence
  Oligonucleotide probe
  misc_binding (1)..(15): Hybridization probe for the specific detection of mutant HIV-1 at codon 47 of the protease gene.
  modified_base (8)..(8): base is a locked nucleic acid
  modified_base (9)..(9): base is a locked nucleic acid
caaraatgtaggrgg

SEQ ID NO: 12658 - DNA, 15 bp, Artificial Sequence
  Oligonucleotide probe
  misc_binding (1)..(15): Hybridization probe for the specific detection of mutant HIV-1 at codon 47 of the protease gene.
  modified_base (4)..(4): base is a locked nucleic acid
caaraatgtaggrgg

SEQ ID NO: 12659 - DNA, 15 bp, Artificial Sequence
  Oligonucleotide probe
  misc_binding (1)..(15): Hybridization probe for the specific detection of mutant HIV-1 at codon 47 of the protease gene.
  modified_base (8)..(8): base is a locked nucleic acid
caaraatgtaggrgg

SEQ ID NO: 12660 - DNA, 15 bp, Artificial Sequence
  Oligonucleotide probe
  misc_binding (1)..(15): Hybridization probe for the specific detection of mutant HIV-1 at codon 47 of the protease gene.
  modified_base (2)..(2): base is a locked nucleic acid
caaraatgtaggrgg

SEQ ID NO: 12661 - DNA, 15 bp, Artificial Sequence
  Oligonucleotide probe
  misc_binding (1)..(15): Hybridization probe for the specific detection of mutant HIV-1 at codon 47 of the protease gene.
  modified_base (7)..(7): base is a locked nucleic acid
caaraatgtaggrgg

SEQ ID NO: 12662 - DNA, 15 bp, Artificial Sequence
  Oligonucleotide probe
  misc_binding (1)..(15): Hybridization probe for the specific detection of mutant HIV-1 at codon 47 of the protease gene.
  modified_base (13)..(13): base is a locked nucleic acid
caaraatgtaggrgg

SEQ ID NO: 12663 - DNA, 15 bp, Artificial Sequence
  Oligonucleotide probe
  misc_binding (1)..(15): Hybridization probe for the specific detection of mutant HIV-1 at codon 47 of the protease gene.
  modified_base (14)..(14): base is a locked nucleic acid
caaraatgtaggrgg

SEQ ID NO: 12664 - DNA, 15 bp, Artificial Sequence
  Oligonucleotide probe
  misc_binding (1)..(15): Hybridization probe for the specific detection of mutant HIV-1 at codon 47 of the protease gene.
  modified_base (15)..(15): base is a locked nucleic acid
caaraatgtaggrgg

SEQ ID NO: 12665 - DNA, 15 bp, Artificial Sequence
  Oligonucleotide probe
  misc_binding (1)..(15): Hybridization probe for the specific detection of mutant HIV-1 at codon 47 of the protease gene.
  modified_base (11)..(11): base is a locked nucleic acid
caaraatgtaggrgg

SEQ ID NO: 12666 - DNA, 15 bp, Artificial Sequence
  Oligonucleotide probe
  misc_binding (1)..(15): Hybridization probe for the specific detection of mutant HIV-1 at codon 47 of the protease gene.
  modified_base (3)..(3): base is a locked nucleic acid
  modified_base (8)..(8): base is a locked nucleic acid
  modified_base (9)..(9): base is a locked nucleic acid
caaraatgtaggrgg

SEQ ID NO: 12667 - DNA, 15 bp, Artificial Sequence
  Oligonucleotide probe
  misc_binding (1)..(15): Hybridization probe for the specific detection of mutant HIV-1 at codon 47 of the protease gene.
  modified_base (2)..(2): base is a locked nucleic acid
  modified_base (8)..(8): base is a locked nucleic acid
  modified_base (9)..(9): base is a locked nucleic acid
caaraatgtaggrgg

SEQ ID NO: 12668 - DNA, 15 bp, Artificial Sequence
  Oligonucleotide probe
  misc_binding (1)..(15): Hybridization probe for the specific detection of mutant HIV-1 at codon 47 of the protease gene.
  modified_base (1)..(1): base is a locked nucleic acid
  modified_base (8)..(8): base is a locked nucleic acid
  modified_base (9)..(9): base is a locked nucleic acid
caaraatgtaggrgg

SEQ ID NO: 12669 - DNA, 15 bp, Artificial Sequence
  Oligonucleotide probe
  misc_binding (1)..(15): Hybridization probe for the specific detection of mutant HIV-1 at codon 47 of the protease gene.
  modified_base (7)..(7): base is a locked nucleic acid
  modified_base (8)..(8): base is a locked nucleic acid
  modified_base (9)..(9): base is a locked nucleic acid
caaraatgtaggrgg

SEQ ID NO: 12670 - DNA, 15 bp, Artificial Sequence
  Oligonucleotide probe
  misc_binding (1)..(15): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (11)..(11): base is a locked nucleic acid
caaraatgtaggrgg

SEQ ID NO: 12671 - DNA, 15 bp, Artificial Sequence
  Oligonucleotide probe
  misc_binding (1)..(15): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (14)..(14): base is a locked nucleic acid
caaraatgtaggrgg

SEQ ID NO: 12672 - DNA, 15 bp, Artificial Sequence
  Oligonucleotide probe
  misc_binding (1)..(15): Hybridization probe for the specific detection of mutant HIV-1 at codon 47 of the protease gene.
  modified_base (8)..(8): base is a locked nucleic acid
  modified_base (9)..(9): base is a locked nucleic acid
  modified_base (12)..(12): base is a locked nucleic acid
caaraatgtaggrgg

SEQ ID NO: 12673 - DNA, 15 bp, Artificial Sequence
  Oligonucleotide probe
  misc_binding (1)..(15): Hybridization probe for the specific detection of mutant HIV-1 at codon 47 of the protease gene.
  modified_base (8)..(8): base is a locked nucleic acid
  modified_base (9)..(9): base is a locked nucleic acid
caaraatgtaggrgg

SEQ ID NO: 12674 - DNA, 15 bp, Artificial Sequence
  Oligonucleotide probe
  misc_binding (1)..(15): Hybridization probe for the specific detection of mutant HIV-1 at codon 47 of the protease gene.
aaaatggtaggggga

SEQ ID NO: 12675 - DNA, 15 bp, Artificial Sequence
  Oligonucleotide probe
  misc_binding (1)..(15): Hybridization probe for the specific detection of mutant HIV-1 at codon 47 of the protease gene.
aaaatgctaggggga

SEQ ID NO: 12676 - DNA, 19 bp, Artificial Sequence
  Oligonucleotide probe
  misc_binding (1)..(19): Hybridization probe for the specific detection of mutant HIV-1 at codon 47 of the protease gene.
ccaaraatgtaggrggaat

SEQ ID NO: 12677 - DNA, 18 bp, Artificial Sequence
  Oligonucleotide probe
  misc_binding (1)..(18): Hybridization probe for the specific detection of mutant HIV-1 at codon 47 of the protease gene.
ccaaraatgtaggrggaa

SEQ ID NO: 12678 - DNA, 17 bp, Artificial Sequence
  Oligonucleotide probe
  misc_binding (1)..(17): Hybridization probe for the specific detection of mutant HIV-1 at codon 47 of the protease gene.
caaraatgtaggrggaa

SEQ ID NO: 12679 - DNA, 15 bp, Artificial Sequence
  Oligonucleotide probe
  misc_binding (1)..(15): Hybridization probe for the specific detection of mutant HIV-1 at codon 47 of the protease gene.
caaraatgtaggrgg

SEQ ID NO: 12680 - DNA, 15 bp, Artificial Sequence
  Oligonucleotide probe
  misc_binding (1)..(15): Hybridization probe for the specific detection of mutant HIV-1 at codon 48 of the protease gene.
atgatagtrggaatt

SEQ ID NO: 12681 - DNA, 15 bp, Artificial Sequence
  Oligonucleotide probe
  misc_binding (1)..(15): Hybridization probe for the specific detection of mutant HIV-1 at codon 48 of the protease gene.
atgataatgggaatt

SEQ ID NO: 12682 - DNA, 15 bp, Artificial Sequence
  Oligonucleotide probe
  misc_binding (1)..(15): Hybridization probe for the specific detection of mutant HIV-1 at codon 48 of the protease gene.
atgatagcrggaatt

SEQ ID NO: 12683 - DNA, 15 bp, Artificial Sequence
  Oligonucleotide probe
  misc_binding (1)..(15): Hybridization probe for the specific detection of mutant HIV-1 at codon 48 of the protease gene.
atgataagyggaatt

SEQ ID NO: 12684 - DNA, 15 bp, Artificial Sequence
  Oligonucleotide probe
  misc_binding (1)..(15): Hybridization probe for the specific detection of mutant HIV-1 at codon 48 of the protease gene.
atgataacrggaatt

SEQ ID NO: 12685 - DNA, 15 bp, Artificial Sequence
  Oligonucleotide probe
  misc_binding (1)..(15): Hybridization probe for the specific detection of mutant HIV-1 at codon 48 of the protease gene.
atgataytrggaatt

SEQ ID NO: 12686 - DNA, 15 bp, Artificial Sequence
  Oligonucleotide probe
  misc_binding (1)..(15): Hybridization probe for the specific detection of mutant HIV-1 at codon 48 of the protease gene.
atgatacarggaatt

SEQ ID NO: 12687 - DNA, 19 bp, Artificial Sequence
  Oligonucleotide probe
  misc_binding (1)..(19): Hybridization probe for the specific detection of mutant HIV-1 at codon 50 of the protease gene.
  modified_base (9)..(9): base is a locked nucleic acid
  modified_base (10)..(10): base is a locked nucleic acid
ataggrggattggaggytt

SEQ ID NO: 12688 - DNA, 19 bp, Artificial Sequence
  Oligonucleotide probe
  misc_binding (1)..(19): Hybridization probe for the specific detection of mutant HIV-1 at codon 50 of the protease gene.
  modified_base (7)..(7): base is a locked nucleic acid
ataggrggattggaggytt

SEQ ID NO: 12689 - DNA, 19 bp, Artificial Sequence
  Oligonucleotide probe
  misc_binding (1)..(19): Hybridization probe for the specific detection of mutant HIV-1 at codon 50 of the protease gene.
  modified_base (5)..(5): base is a locked nucleic acid
ataggrggattggaggytt

SEQ ID NO: 12690 - DNA, 19 bp, Artificial Sequence
  Oligonucleotide probe
  misc_binding (1)..(19): Hybridization probe for the specific detection of mutant HIV-1 at codon 50 of the protease gene.
  modified_base (8)..(8): base is a locked nucleic acid
ataggrggattggaggytt

SEQ ID NO: 12691 - DNA, 19 bp, Artificial Sequence
  Oligonucleotide probe
  misc_binding (1)..(19): Hybridization probe for the specific detection of mutant HIV-1 at codon 50 of the protease gene.
  modified_base (3)..(3): base is a locked nucleic acid
ataggrggattggaggytt

SEQ ID NO: 12692 - DNA, 19 bp, Artificial Sequence
  Oligonucleotide probe
  misc_binding (1)..(19): Hybridization probe for the specific detection of mutant HIV-1 at codon 50 of the protease gene.
  modified_base (12)..(12): base is a locked nucleic acid
ataggrggattggaggytt

SEQ ID NO: 12693 - DNA, 19 bp, Artificial Sequence
  Oligonucleotide probe
  misc_binding (1)..(19): Hybridization probe for the specific detection of mutant HIV-1 at codon 50 of the protease gene.
  modified_base (16)..(16): base is a locked nucleic acid
ataggrggattggaggytt

SEQ ID NO: 12694 - DNA, 19 bp, Artificial Sequence
  Oligonucleotide probe
  misc_binding (1)..(19): Hybridization probe for the specific detection of mutant HIV-1 at codon 50 of the protease gene.
  modified_base (10)..(10): base is a locked nucleic acid
ataggrggattggaggytt

SEQ ID NO: 12695 - DNA, 19 bp, Artificial Sequence
  Oligonucleotide probe
  misc_binding (1)..(19): Hybridization probe for the specific detection of mutant HIV-1 at codon 50 of the protease gene.
  modified_base (14)..(14): base is a locked nucleic acid
ataggrggattggaggytt

SEQ ID NO: 12696 - DNA, 19 bp, Artificial Sequence
  Oligonucleotide probe
  misc_binding (1)..(19): Hybridization probe for the specific detection of mutant HIV-1 at codon 50 of the protease gene.
  modified_base (7)..(7): base is a locked nucleic acid
  modified_base (9)..(9): base is a locked nucleic acid
  modified_base (10)..(10): base is a locked nucleic acid
ataggrggattggaggytt

SEQ ID NO: 12697 - DNA, 19 bp, Artificial Sequence
  Oligonucleotide probe
  misc_binding (1)..(19): Hybridization probe for the specific detection of mutant HIV-1 at codon 50 of the protease gene.
  modified_base (6)..(6): base is a locked nucleic acid
  modified_base (9)..(9): base is a locked nucleic acid
  modified_base (10)..(10): base is a locked nucleic acid
ataggrggattggaggytt

SEQ ID NO: 12698 - DNA, 19 bp, Artificial Sequence
  Oligonucleotide probe
  misc_binding (1)..(19): Hybridization probe for the specific detection of mutant HIV-1 at codon 50 of the protease gene.
  modified_base (2)..(2): base is a locked nucleic acid
  modified_base (9)..(9): base is a locked nucleic acid
  modified_base (10)..(10): base is a locked nucleic acid
ataggrggattggaggytt

SEQ ID NO: 12699 - DNA, 19 bp, Artificial Sequence
  Oligonucleotide probe
  misc_binding (1)..(19): Hybridization probe for the specific detection of mutant HIV-1 at codon 50 of the protease gene.
  modified_base (3)..(3): base is a locked nucleic acid
  modified_base (9)..(9): base is a locked nucleic acid
  modified_base (10)..(10): base is a locked nucleic acid
ataggrggattggaggytt

SEQ ID NO: 12700 - DNA, 19 bp, Artificial Sequence
  Oligonucleotide probe
  misc_binding (1)..(19): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (17)..(17): base is a locked nucleic acid
ataggrggattggaggytt

SEQ ID NO: 12701 - DNA, 19 bp, Artificial Sequence
  Oligonucleotide probe
  misc_binding (1)..(19): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (16)..(16): base is a locked nucleic acid
ataggrggattggaggytt

SEQ ID NO: 12702 - DNA, 19 bp, Artificial Sequence
  Oligonucleotide probe
  misc_binding (1)..(19): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (13)..(13): base is a locked nucleic acid
ataggrggattggaggytt

SEQ ID NO: 12703 - DNA, 19 bp, Artificial Sequence
  Oligonucleotide probe
  misc_binding (1)..(19): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (15)..(15): base is a locked nucleic acid
ataggrggattggaggytt

SEQ ID NO: 12704 - DNA, 18 bp, Artificial Sequence
  Oligonucleotide probe
  misc_binding (1)..(18): Hybridization probe for the specific detection of mutant HIV-1 at codon 50 of the protease gene.
  modified_base (9)..(9): base is a locked nucleic acid
  modified_base (10)..(10): base is a locked nucleic acid
ataggrggattggaggyt

SEQ ID NO: 12705 - DNA, 18 bp, Artificial Sequence
  Oligonucleotide probe
  misc_binding (1)..(18): Hybridization probe for the specific detection of mutant HIV-1 at codon 50 of the protease gene.
  modified_base (7)..(7): base is a locked nucleic acid
ataggrggattggaggyt

SEQ ID NO: 12706 - DNA, 18 bp, Artificial Sequence
  Oligonucleotide probe
  misc_binding (1)..(18): Hybridization probe for the specific detection of mutant HIV-1 at codon 50 of the protease gene.
  modified_base (5)..(5): base is a locked nucleic acid
ataggrggattggaggyt

SEQ ID NO: 12707 - DNA, 18 bp, Artificial Sequence
  Oligonucleotide probe
  misc_binding (1)..(18): Hybridization probe for the specific detection of mutant HIV-1 at codon 50 of the protease gene.
  modified_base (8)..(8): base is a locked nucleic acid
ataggrggattggaggyt

SEQ ID NO: 12708 - DNA, 18 bp, Artificial Sequence
  Oligonucleotide probe
  misc_binding (1)..(18): Hybridization probe for the specific detection of mutant HIV-1 at codon 50 of the protease gene.
  modified_base (3)..(3): base is a locked nucleic acid
ataggrggattggaggyt

SEQ ID NO: 12709 - DNA, 18 bp, Artificial Sequence
  Oligonucleotide probe
  misc_binding (1)..(18): Hybridization probe for the specific detection of mutant HIV-1 at codon 50 of the protease gene.
  modified_base (12)..(12): base is a locked nucleic acid
ataggrggattggaggyt

SEQ ID NO: 12710 - DNA, 18 bp, Artificial Sequence
  Oligonucleotide probe
  misc_binding (1)..(18): Hybridization probe for the specific detection of mutant HIV-1 at codon 50 of the protease gene.
  modified_base (16)..(16): base is a locked nucleic acid
ataggrggattggaggyt

SEQ ID NO: 12711 - DNA, 18 bp, Artificial Sequence
  Oligonucleotide probe
  misc_binding (1)..(18): Hybridization probe for the specific detection of mutant HIV-1 at codon 50 of the protease gene.
  modified_base (10)..(10): base is a locked nucleic acid
ataggrggattggaggyt

SEQ ID NO: 12712 - DNA, 18 bp, Artificial Sequence
  Oligonucleotide probe
  misc_binding (1)..(18): Hybridization probe for the specific detection of mutant HIV-1 at codon 50 of the protease gene.
  modified_base (14)..(14): base is a locked nucleic acid
ataggrggattggaggyt

SEQ ID NO: 12713 - DNA, 18 bp, Artificial Sequence
  Oligonucleotide probe
  misc_binding (1)..(18): Hybridization probe for the specific detection of mutant HIV-1 at codon 50 of the protease gene.
  modified_base (7)..(7): base is a locked nucleic acid
  modified_base (9)..(9): base is a locked nucleic acid
  modified_base (10)..(10): base is a locked nucleic acid
ataggrggattggaggyt

SEQ ID NO: 12714 - DNA, 18 bp, Artificial Sequence
  Oligonucleotide probe
  misc_binding (1)..(18): Hybridization probe for the specific detection of mutant HIV-1 at codon 50 of the protease gene.
  modified_base (6)..(6): base is a locked nucleic acid
  modified_base (9)..(9): base is a locked nucleic acid
  modified_base (10)..(10): base is a locked nucleic acid
ataggrggattggaggyt

SEQ ID NO: 12715 - DNA, 18 bp, Artificial Sequence
  Oligonucleotide probe
  misc_binding (1)..(18): Hybridization probe for the specific detection of mutant HIV-1 at codon 50 of the protease gene.
  modified_base (2)..(2): base is a locked nucleic acid
  modified_base (9)..(9): base is a locked nucleic acid
  modified_base (10)..(10): base is a locked nucleic acid
ataggrggattggaggyt

SEQ ID NO: 12716 - DNA, 18 bp, Artificial Sequence
  Oligonucleotide probe
  misc_binding (1)..(18): Hybridization probe for the specific detection of mutant HIV-1 at codon 50 of the protease gene.
  modified_base (3)..(3): base is a locked nucleic acid
  modified_base (9)..(9): base is a locked nucleic acid
  modified_base (10)..(10): base is a locked nucleic acid
ataggrggattggaggyt

SEQ ID NO: 12717 - DNA, 18 bp, Artificial Sequence
  Oligonucleotide probe
  misc_binding (1)..(18): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (17)..(17): base is a locked nucleic acid
ataggrggattggaggyt

SEQ ID NO: 12718 - DNA, 18 bp, Artificial Sequence
  Oligonucleotide probe
  misc_binding (1)..(18): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (16)..(16): base is a locked nucleic acid
ataggrggattggaggyt

SEQ ID NO: 12719 - DNA, 18 bp, Artificial Sequence
  Oligonucleotide probe
  misc_binding (1)..(18): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (13)..(13): base is a locked nucleic acid
ataggrggattggaggyt

SEQ ID NO: 12720 - DNA, 18 bp, Artificial Sequence
  Oligonucleotide probe
  misc_binding (1)..(18): Hybridization probe for the specific detection of mutant HIV-1 at codon 50 of the protease gene.
  modified_base (9)..(9): base is a locked nucleic acid
  modified_base (10)..(10): base is a locked nucleic acid
  modified_base (15)..(15): base is a locked nucleic acid
ataggrggattggaggyt

SEQ ID NO: 12721 - DNA, 17 bp, Artificial Sequence
  Oligonucleotide probe
  misc_binding (1)..(17): Hybridization probe for the specific detection of mutant HIV-1 at codon 50 of the protease gene.
  modified_base (8)..(8): base is a locked nucleic acid
  modified_base (9)..(9): base is a locked nucleic acid
taggrggattggaggyt

SEQ ID NO: 12722 - DNA, 17 bp, Artificial Sequence
  Oligonucleotide probe
  misc_binding (1)..(17): Hybridization probe for the specific detection of mutant HIV-1 at codon 50 of the protease gene.
  modified_base (6)..(6): base is a locked nucleic acid
taggrggattggaggyt

SEQ ID NO: 12723 - DNA, 17 bp, Artificial Sequence
  Oligonucleotide probe
  misc_binding (1)..(17): Hybridization probe for the specific detection of mutant HIV-1 at codon 50 of the protease gene.
  modified_base (4)..(4): base is a locked nucleic acid
taggrggattggaggyt

SEQ ID NO: 12724 - DNA, 17 bp, Artificial Sequence
  Oligonucleotide probe
  misc_binding (1)..(17): Hybridization probe for the specific detection of mutant HIV-1 at codon 50 of the protease gene.
  modified_base (7)..(7): base is a locked nucleic acid
taggrggattggaggyt

SEQ ID NO: 12725 - DNA, 17 bp, Artificial Sequence
  Oligonucleotide probe
  misc_binding (1)..(17): Hybridization probe for the specific detection of mutant HIV-1 at codon 50 of the protease gene.
  modified_base (2)..(2): base is a locked nucleic acid
taggrggattggaggyt

SEQ ID NO: 12726 - DNA, 17 bp, Artificial Sequence
  Oligonucleotide probe
  misc_binding (1)..(17): Hybridization probe for the specific detection of mutant HIV-1 at codon 50 of the protease gene.
  modified_base (11)..(11): base is a locked nucleic acid
taggrggattggaggyt

SEQ ID NO: 12727 - DNA, 17 bp, Artificial Sequence
  Oligonucleotide probe
  misc_binding (1)..(17): Hybridization probe for the specific detection of mutant HIV-1 at codon 50 of the protease gene.
  modified_base (15)..(15): base is a locked nucleic acid
taggrggattggaggyt

SEQ ID NO: 12728 - DNA, 17 bp, Artificial Sequence
  Oligonucleotide probe
  misc_binding (1)..(17): Hybridization probe for the specific detection of mutant HIV-1 at codon 50 of the protease gene.
  modified_base (9)..(9): base is a locked nucleic acid
taggrggattggaggyt

SEQ ID NO: 12729 - DNA, 17 bp, Artificial Sequence
  Oligonucleotide probe
  misc_binding (1)..(17): Hybridization probe for the specific detection of mutant HIV-1 at codon 50 of the protease gene.
  modified_base (13)..(13): base is a locked nucleic acid
taggrggattggaggyt

SEQ ID NO: 12730 - DNA, 17 bp, Artificial Sequence
  Oligonucleotide probe
  misc_binding (1)..(17): Hybridization probe for the specific detection of mutant HIV-1 at codon 50 of the protease gene.
  modified_base (6)..(6): base is a locked nucleic acid
  modified_base (8)..(8): base is a locked nucleic acid
  modified_base (9)..(9): base is a locked nucleic acid
taggrggattggaggyt

SEQ ID NO: 12731 - DNA, 17 bp, Artificial Sequence
  Oligonucleotide probe
  misc_binding (1)..(17): Hybridization probe for the specific detection of mutant HIV-1 at codon 50 of the protease gene.
  modified_base (5)..(5): base is a locked nucleic acid
  modified_base (8)..(8): base is a locked nucleic acid
  modified_base (9)..(9): base is a locked nucleic acid
taggrggattggaggyt

SEQ ID NO: 12732 - DNA, 17 bp, Artificial Sequence
  Oligonucleotide probe
  misc_binding (1)..(17): Hybridization probe for the specific detection of mutant HIV-1 at codon 50 of the protease gene.
  modified_base (1)..(1): base is a locked nucleic acid
  modified_base (8)..(8): base is a locked nucleic acid
  modified_base (9)..(9): base is a locked nucleic acid
taggrggattggaggyt

SEQ ID NO: 12733 - DNA, 17 bp, Artificial Sequence
  Oligonucleotide probe
  misc_binding (1)..(17): Hybridization probe for the specific detection of mutant HIV-1 at codon 50 of the protease gene.
  modified_base (2)..(2): base is a locked nucleic acid
  modified_base (8)..(8): base is a locked nucleic acid
  modified_base (9)..(9): base is a locked nucleic acid
taggrggattggaggyt

SEQ ID NO: 12734 - DNA, 17 bp, Artificial Sequence
  Oligonucleotide probe
  misc_binding (1)..(17): Hybridization probe for the specific detection of mutant HIV-1 at codon 50 of the protease gene.
  modified_base (8)..(8): base is a locked nucleic acid
  modified_base (9)..(9): base is a locked nucleic acid
  modified_base (16)..(16): base is a locked nucleic acid
taggrggattggaggyt

SEQ ID NO: 12735 - DNA, 17 bp, Artificial Sequence
  Oligonucleotide probe
  misc_binding (1)..(17): Hybridization probe for the specific detection of mutant HIV-1 at codon 50 of the protease gene.
  modified_base (8)..(8): base is a locked nucleic acid
  modified_base (9)..(9): base is a locked nucleic acid
  modified_base (15)..(15): base is a locked nucleic acid
taggrggattggaggyt

SEQ ID NO: 12736 - DNA, 17 bp, Artificial Sequence
  Oligonucleotide probe
  misc_binding (1)..(17): Hybridization probe for the specific detection of mutant HIV-1 at codon 50 of the protease gene.
  modified_base (8)..(8): base is a locked nucleic acid
  modified_base (9)..(9): base is a locked nucleic acid
  modified_base (12)..(12): base is a locked nucleic acid
taggrggattggaggyt

SEQ ID NO: 12737 - DNA, 17 bp, Artificial Sequence
  Oligonucleotide probe
  misc_binding (1)..(17): Hybridization probe for the specific detection of mutant HIV-1 at codon 50 of the protease gene.
  modified_base (8)..(8): base is a locked nucleic acid
  modified_base (9)..(9): base is a locked nucleic acid
  modified_base (14)..(14): base is a locked nucleic acid
taggrggattggaggyt

SEQ ID NO: 12738 - DNA, 15 bp, Artificial Sequence
  Oligonucleotide probe
  misc_binding (1)..(15): Hybridization probe for the specific detection of mutant HIV-1 at codon 50 of the protease gene.
  modified_base (8)..(8): base is a locked nucleic acid
  modified_base (9)..(9): base is a locked nucleic acid
taggrggattggagg

SEQ ID NO: 12739 - DNA, 15 bp, Artificial Sequence
  Oligonucleotide probe
  misc_binding (1)..(15): Hybridization probe for the specific detection of mutant HIV-1 at codon 50 of the protease gene.
  modified_base (6)..(6): base is a locked nucleic acid
taggrggattggagg

SEQ ID NO: 12740 - DNA, 15 bp, Artificial Sequence
  Oligonucleotide probe
  misc_binding (1)..(15): Hybridization probe for the specific detection of mutant HIV-1 at codon 50 of the protease gene.
  modified_base (4)..(4): base is a locked nucleic acid
taggrggattggagg

SEQ ID NO: 12741 - DNA, 15 bp, Artificial Sequence
  Oligonucleotide probe
  misc_binding (1)..(15): Hybridization probe for the specific detection of mutant HIV-1 at codon 50 of the protease gene.
  modified_base (7)..(7): base is a locked nucleic acid
taggrggattggagg

SEQ ID NO: 12742 - DNA, 15 bp, Artificial Sequence
  Oligonucleotide probe
  misc_binding (1)..(15): Hybridization probe for the specific detection of mutant HIV-1 at codon 50 of the protease gene.
  modified_base (2)..(2): base is a locked nucleic acid
taggrggattggagg

SEQ ID NO: 12743 - DNA, 15 bp, Artificial Sequence
  Oligonucleotide probe
  misc_binding (1)..(15): Hybridization probe for the specific detection of mutant HIV-1 at codon 50 of the protease gene.
  modified_base (11)..(11): base is a locked nucleic acid
taggrggattggagg

SEQ ID NO: 12744 - DNA, 15 bp, Artificial Sequence
  Oligonucleotide probe
  misc_binding (1)..(15): Hybridization probe for the specific detection of mutant HIV-1 at codon 50 of the protease gene.
  modified_base (15)..(15): base is a locked nucleic acid
taggrggattggagg

SEQ ID NO: 12745 - DNA, 15 bp, Artificial Sequence
  Oligonucleotide probe
  misc_binding (1)..(15): Hybridization probe for the specific detection of mutant HIV-1 at codon 50 of the protease gene.
  modified_base (9)..(9): base is a locked nucleic acid
taggrggattggagg

SEQ ID NO: 12746 - DNA, 15 bp, Artificial Sequence
  Oligonucleotide probe
  misc_binding (1)..(15): Hybridization probe for the specific detection of mutant HIV-1 at codon 50 of the protease gene.
  modified_base (13)..(13): base is a locked nucleic acid
taggrggattggagg

SEQ ID NO: 12747 - DNA, 15 bp, Artificial Sequence
  Oligonucleotide probe
  misc_binding (1)..(15): Hybridization probe for the specific detection of mutant HIV-1 at codon 50 of the protease gene.
  modified_base (6)..(6): base is a locked nucleic acid
  modified_base (8)..(8): base is a locked nucleic acid
  modified_base (9)..(9): base is a locked nucleic acid
taggrggattggagg

SEQ ID NO: 12748 - DNA, 15 bp, Artificial Sequence
  Oligonucleotide probe
  misc_binding (1)..(15): Hybridization probe for the specific detection of mutant HIV-1 at codon 50 of the protease gene.
  modified_base (5)..(5): base is a locked nucleic acid
  modified_base (8)..(8): base is a locked nucleic acid
  modified_base (9)..(9): base is a locked nucleic acid
taggrggattggagg

SEQ ID NO: 12749 - DNA, 15 bp, Artificial Sequence
  Oligonucleotide probe
  misc_binding (1)..(15): Hybridization probe for the specific detection of mutant HIV-1 at codon 50 of the protease gene.
  modified_base (1)..(1): base is a locked nucleic acid
  modified_base (8)..(8): base is a locked nucleic acid
  modified_base (9)..(9): base is a locked nucleic acid
taggrggattggagg

SEQ ID NO: 12750 - DNA, 15 bp, Artificial Sequence
  Oligonucleotide probe
  misc_binding (1)..(15): Hybridization probe for the specific detection of mutant HIV-1 at codon 50 of the protease gene.
  modified_base (2)..(2): base is a locked nucleic acid
  modified_base (8)..(8): base is a locked nucleic acid
  modified_base (9)..(9): base is a locked nucleic acid
taggrggattggagg

SEQ ID NO: 12751 - DNA, 15 bp, Artificial Sequence
  Oligonucleotide probe
  misc_binding (1)..(15): Hybridization probe for the specific detection of mutant HIV-1 at codon 50 of the protease gene.
  modified_base (8)..(8): base is a locked nucleic acid
  modified_base (9)..(9): base is a locked nucleic acid
taggrggattggagg

SEQ ID NO: 12752 - DNA, 15 bp, Artificial Sequence
  Oligonucleotide probe
  misc_binding (1)..(15): Hybridization probe for the specific detection of mutant HIV-1 at codon 50 of the protease gene.
  modified_base (8)..(8): base is a locked nucleic acid
  modified_base (9)..(9): base is a locked nucleic acid
  modified_base (15)..(15): base is a locked nucleic acid
taggrggattggagg

SEQ ID NO: 12753 - DNA, 15 bp, Artificial Sequence
  Oligonucleotide probe
  misc_binding (1)..(15): Hybridization probe for the specific detection of mutant HIV-1 at codon 50 of the protease gene.
  modified_base (8)..(8): base is a locked nucleic acid
  modified_base (9)..(9): base is a locked nucleic acid
  modified_base (12)..(12): base is a locked nucleic acid
taggrggattggagg

SEQ ID NO: 12754 - DNA, 15 bp, Artificial Sequence
  Oligonucleotide probe
  misc_binding (1)..(15): Hybridization probe for the specific detection of mutant HIV-1 at codon 50 of the protease gene.
  modified_base (8)..(8): base is a locked nucleic acid
  modified_base (9)..(9): base is a locked nucleic acid
  modified_base (14)..(14): base is a locked nucleic acid
taggrggattggagg

SEQ ID NO: 12755 - DNA, 15 bp, Artificial Sequence
  Oligonucleotide probe
  misc_binding (1)..(15): Hybridization probe for the specific detection of mutant HIV-1 at codon 50 of the protease gene.
acctccaactccccc

SEQ ID NO: 12756 - DNA, 15 bp, Artificial Sequence
  Oligonucleotide probe
  misc_binding (1)..(15): Hybridization probe for the specific detection of mutant HIV-1 at codon 50 of the protease gene.
acctccaagtccccc

SEQ ID NO: 12757 - DNA, 19 bp, Artificial Sequence
  Oligonucleotide probe
  misc_binding (1)..(19): Hybridization probe for the specific detection of mutant HIV-1 at codon 50 of the protease gene.
ataggrggattggaggytt

SEQ ID NO: 12758 - DNA, 18 bp, Artificial Sequence
  Oligonucleotide probe
  misc_binding (1)..(18): Hybridization probe for the specific detection of mutant HIV-1 at codon 50 of the protease gene.
ataggrggattggaggyt

SEQ ID NO: 12759 - DNA, 17 bp, Artificial Sequence
  Oligonucleotide probe
  misc_binding (1)..(17): Hybridization probe for the specific detection of mutant HIV-1 at codon 50 of the protease gene.
taggrggattggaggyt

SEQ ID NO: 12760 - DNA, 15 bp, Artificial Sequence
  Oligonucleotide probe
  misc_binding (1)..(15): Hybridization probe for the specific detection of mutant HIV-1 at codon 50 of the protease gene.
taggrggattggagg

SEQ ID NO: 12761 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
tggaggyttatyaargtaa

SEQ ID NO: 12762 - DNA, 19 bp, Artificial Sequence
  Oligonucleotide probe
  misc_binding (1)..(19): Hybridization probe for the specific detection of mutant HIV-1 at codon 53 of the protease gene.
  modified_base (8)..(8): base is a locked nucleic acid
tggaggyttatyaargtaa

SEQ ID NO: 12763 - DNA, 19 bp, Artificial Sequence
  Oligonucleotide probe
  misc_binding (1)..(19): Hybridization probe for the specific detection of mutant HIV-1 at codon 53 of the protease gene.
  modified_base (2)..(2): base is a locked nucleic acid
tggaggyttatyaargtaa

SEQ ID NO: 12764 - DNA, 19 bp, Artificial Sequence
  Oligonucleotide probe
  misc_binding (1)..(19): Hybridization probe for the specific detection of mutant HIV-1 at codon 53 of the protease gene.
  modified_base (7)..(7): base is a locked nucleic acid
tggaggyttatyaargtaa

SEQ ID NO: 12765 - DNA, 19 bp, Artificial Sequence
  Oligonucleotide probe
  misc_binding (1)..(19): Hybridization probe for the specific detection of mutant HIV-1 at codon 53 of the protease gene.
  modified_base (3)..(3): base is a locked nucleic acid
tggaggyttatyaargtaa

SEQ ID NO: 12766 - DNA, 19 bp, Artificial Sequence
  Oligonucleotide probe
  misc_binding (1)..(19): Hybridization probe for the specific detection of mutant HIV-1 at codon 53 of the protease gene.
  modified_base (14)..(14): base is a locked nucleic acid
tggaggyttatyaargtaa

SEQ ID NO: 12767 - DNA, 19 bp, Artificial Sequence
  Oligonucleotide probe
  misc_binding (1)..(19): Hybridization probe for the specific detection of mutant HIV-1 at codon 53 of the protease gene.
  modified_base (16)..(16): base is a locked nucleic acid
tggaggyttatyaargtaa

SEQ ID NO: 12768 - DNA, 19 bp, Artificial Sequence
  Oligonucleotide probe
  misc_binding (1)..(19): Hybridization probe for the specific detection of mutant HIV-1 at codon 53 of the protease gene.
  modified_base (10)..(10): base is a locked nucleic acid
tggaggyttatyaargtaa

SEQ ID NO: 12769 - DNA, 19 bp, Artificial Sequence
  Oligonucleotide probe
  misc_binding (1)..(19): Hybridization probe for the specific detection of mutant HIV-1 at codon 53 of the protease gene.
  modified_base (13)..(13): base is a locked nucleic acid
tggaggyttatyaargtaa

SEQ ID NO: 12770 - DNA, 19 bp, Artificial Sequence
  Oligonucleotide probe
  misc_binding (1)..(19): Hybridization probe for the specific detection of mutant HIV-1 at codon 53 of the protease gene.
  modified_base (5)..(5): base is a locked nucleic acid
  modified_base (9)..(9): base is a locked nucleic acid
  modified_base (10)..(10): base is a locked nucleic acid
tggaggyttatyaargtaa

SEQ ID NO: 12771 - DNA, 19 bp, Artificial Sequence
  Oligonucleotide probe
  misc_binding (1)..(19): Hybridization probe for the specific detection of mutant HIV-1 at codon 53 of the protease gene.
  modified_base (3)..(3): base is a locked nucleic acid
  modified_base (9)..(9): base is a locked nucleic acid
  modified_base (10)..(10): base is a locked nucleic acid
tggaggyttatyaargtaa

SEQ ID NO: 12772 - DNA, 19 bp, Artificial Sequence
  Oligonucleotide probe
  misc_binding (1)..(19): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (10)..(10): base is a locked nucleic acid
tggaggyttatyaargtaa

SEQ ID NO: 12773 - DNA, 19 bp, Artificial Sequence
  Oligonucleotide probe
  misc_binding (1)..(19): Hybridization probe for the specific detection of mutant HIV-1 at codon 53 of the protease gene.
  modified_base (4)..(4): base is a locked nucleic acid
  modified_base (9)..(9): base is a locked nucleic acid
  modified_base (10)..(10): base is a locked nucleic acid
tggaggyttatyaargtaa

SEQ ID NO: 12774 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (13)..(13): base is a locked nucleic acid
tggaggyttatyaargtaa

SEQ ID NO: 12775 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (12)..(12): base is a locked nucleic acid
tggaggyttatyaargtaa

SEQ ID NO: 12776 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (15)..(15): base is a locked nucleic acid
tggaggyttatyaargtaa

SEQ ID NO: 12777 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (16)..(16): base is a locked nucleic acid
tggaggyttatyaargtaa

SEQ ID NO: 12778 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
ttggaggyttatyaargta

SEQ ID NO: 12779 - DNA, 19 bp, Artificial Sequence
  Oligonucleotide probe
  misc_binding (1)..(19): Hybridization probe for the specific detection of mutant HIV-1 at codon 53 of the protease gene.
  modified_base (6)..(6): base is a locked nucleic acid
ttggaggyttatyaargta

SEQ ID NO: 12780 - DNA, 19 bp, Artificial Sequence
  Oligonucleotide probe
  misc_binding (1)..(19): Hybridization probe for the specific detection of mutant HIV-1 at codon 53 of the protease gene.
  modified_base (8)..(8): base is a locked nucleic acid
ttggaggyttatyaargta

SEQ ID NO: 12781 - DNA, 19 bp, Artificial Sequence
  Oligonucleotide probe
  misc_binding (1)..(19): Hybridization probe for the specific detection of mutant HIV-1 at codon 53 of the protease gene.
  modified_base (7)..(7): base is a locked nucleic acid
ttggaggyttatyaargta

SEQ ID NO: 12782 - DNA, 19 bp, Artificial Sequence
  Oligonucleotide probe
  misc_binding (1)..(19): Hybridization probe for the specific detection of mutant HIV-1 at codon 53 of the protease gene.
  modified_base (3)..(3): base is a locked nucleic acid
ttggaggyttatyaargta

SEQ ID NO: 12783 - DNA, 19 bp, Artificial Sequence
  Oligonucleotide probe
  misc_binding (1)..(19): Hybridization probe for the specific detection of mutant HIV-1 at codon 53 of the protease gene.
  modified_base (16)..(16): base is a locked nucleic acid
ttggaggyttatyaargta

SEQ ID NO: 12784 - DNA, 19 bp, Artificial Sequence
  Oligonucleotide probe
  misc_binding (1)..(19): Hybridization probe for the specific detection of mutant HIV-1 at codon 53 of the protease gene.
  modified_base (17)..(17): base is a locked nucleic acid
ttggaggyttatyaargta

SEQ ID NO: 12785 - DNA, 19 bp, Artificial Sequence
  Oligonucleotide probe
  misc_binding (1)..(19): Hybridization probe for the specific detection of mutant HIV-1 at codon 53 of the protease gene.
  modified_base (11)..(11): base is a locked nucleic acid
ttggaggyttatyaargta

SEQ ID NO: 12786 - DNA, 19 bp, Artificial Sequence
  Oligonucleotide probe
  misc_binding (1)..(19): Hybridization probe for the specific detection of mutant HIV-1 at codon 53 of the protease gene.
  modified_base (13)..(13): base is a locked nucleic acid
ttggaggyttatyaargta

SEQ ID NO: 12787 - DNA, 19 bp, Artificial Sequence
  Oligonucleotide probe
  misc_binding (1)..(19): Hybridization probe for the specific detection of mutant HIV-1 at codon 53 of the protease gene.
  modified_base (2)..(2): base is a locked nucleic acid
  modified_base (9)..(9): base is a locked nucleic acid
  modified_base (10)..(10): base is a locked nucleic acid
ttggaggyttatyaargta

SEQ ID NO: 12788 - DNA, 19 bp, Artificial Sequence
  Oligonucleotide probe
  misc_binding (1)..(19): Hybridization probe for the specific detection of mutant HIV-1 at codon 53 of the protease gene.
  modified_base (7)..(7): base is a locked nucleic acid
  modified_base (9)..(9): base is a locked nucleic acid
  modified_base (10)..(10): base is a locked nucleic acid
ttggaggyttatyaargta

SEQ ID NO: 12789 - DNA, 19 bp, Artificial Sequence
  Oligonucleotide probe
  misc_binding (1)..(19): Hybridization probe for the specific detection of mutant HIV-1 at codon 53 of the protease gene.
  modified_base (5)..(5): base is a locked nucleic acid
  modified_base (9)..(9): base is a locked nucleic acid
  modified_base (10)..(10): base is a locked nucleic acid
ttggaggyttatyaargta

SEQ ID NO: 12790 - DNA, 19 bp, Artificial Sequence
  Oligonucleotide probe
  misc_binding (1)..(19): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (10)..(10): base is a locked nucleic acid
ttggaggyttatyaargta

SEQ ID NO: 12791 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (15)..(15): base is a locked nucleic acid
ttggaggyttatyaargta

SEQ ID NO: 12792 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (11)..(11): base is a locked nucleic acid
ttggaggyttatyaargta

SEQ ID NO: 12793 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (17)..(17): base is a locked nucleic acid
ttggaggyttatyaargta

SEQ ID NO: 12794 - DNA, 19 bp, Artificial Sequence
  Oligonucleotide probe
  misc_binding (1)..(19): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (14)..(14): base is a locked nucleic acid
ttggaggyttatyaargta

SEQ ID NO: 12795 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
tggaggyttatyaargta

SEQ ID NO: 12796 - DNA, 18 bp, Artificial Sequence
  Oligonucleotide probe
  misc_binding (1)..(18): Hybridization probe for the specific detection of mutant HIV-1 at codon 53 of the protease gene.
  modified_base (8)..(8): base is a locked nucleic acid
tggaggyttatyaargta

SEQ ID NO: 12797 - DNA, 18 bp, Artificial Sequence
  Oligonucleotide probe
  misc_binding (1)..(18): Hybridization probe for the specific detection of mutant HIV-1 at codon 53 of the protease gene.
  modified_base (2)..(2): base is a locked nucleic acid
tggaggyttatyaargta

SEQ ID NO: 12798 - DNA, 18 bp, Artificial Sequence
  Oligonucleotide probe
  misc_binding (1)..(18): Hybridization probe for the specific detection of mutant HIV-1 at codon 53 of the protease gene.
  modified_base (7)..(7): base is a locked nucleic acid
tggaggyttatyaargta

SEQ ID NO: 12799 - DNA, 18 bp, Artificial Sequence
  Oligonucleotide probe
  misc_binding (1)..(18): Hybridization probe for the specific detection of mutant HIV-1 at codon 53 of the protease gene.
  modified_base (3)..(3): base is a locked nucleic acid
tggaggyttatyaargta

SEQ ID NO: 12800 - DNA, 18 bp, Artificial Sequence
  Oligonucleotide probe
  misc_binding (1)..(18): Hybridization probe for the specific detection of mutant HIV-1 at codon 53 of the protease gene.
  modified_base (14)..(14): base is a locked nucleic acid
tggaggyttatyaargta

SEQ ID NO: 12801 - DNA, 18 bp, Artificial Sequence
  Oligonucleotide probe
  misc_binding (1)..(18): Hybridization probe for the specific detection of mutant HIV-1 at codon 53 of the protease gene.
  modified_base (16)..(16): base is a locked nucleic acid
tggaggyttatyaargta

SEQ ID NO: 12802 - DNA, 18 bp, Artificial Sequence
  Oligonucleotide probe
  misc_binding (1)..(18): Hybridization probe for the specific detection of mutant HIV-1 at codon 53 of the protease gene.
  modified_base (10)..(10): base is a locked nucleic acid
tggaggyttatyaargta

SEQ ID NO: 12803 - DNA, 18 bp, Artificial Sequence
  Oligonucleotide probe
  misc_binding (1)..(18): Hybridization probe for the specific detection of mutant HIV-1 at codon 53 of the protease gene.
  modified_base (13)..(13): base is a locked nucleic acid
tggaggyttatyaargta

SEQ ID NO: 12804 - DNA, 18 bp, Artificial Sequence
  Oligonucleotide probe
  misc_binding (1)..(18): Hybridization probe for the specific detection of mutant HIV-1 at codon 53 of the protease gene.
  modified_base (5)..(5): base is a locked nucleic acid
  modified_base (9)..(9): base is a locked nucleic acid
  modified_base (10)..(10): base is a locked nucleic acid
tggaggyttatyaargta

SEQ ID NO: 12805 - DNA, 18 bp, Artificial Sequence
  Oligonucleotide probe
  misc_binding (1)..(18): Hybridization probe for the specific detection of mutant HIV-1 at codon 53 of the protease gene.
  modified_base (3)..(3): base is a locked nucleic acid
  modified_base (9)..(9): base is a locked nucleic acid
  modified_base (10)..(10): base is a locked nucleic acid
tggaggyttatyaargta

SEQ ID NO: 12806 - DNA, 18 bp, Artificial Sequence
  Oligonucleotide probe
  misc_binding (1)..(18): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (10)..(10): base is a locked nucleic acid
tggaggyttatyaargta

SEQ ID NO: 12807 - DNA, 18 bp, Artificial Sequence
  Oligonucleotide probe
  misc_binding (1)..(18): Hybridization probe for the specific detection of mutant HIV-1 at codon 53 of the protease gene.
  modified_base (4)..(4): base is a locked nucleic acid
  modified_base (9)..(9): base is a locked nucleic acid
  modified_base (10)..(10): base is a locked nucleic acid
tggaggyttatyaargta

SEQ ID NO: 12808 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (13)..(13): base is a locked nucleic acid
tggaggyttatyaargta

SEQ ID NO: 12809 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (12)..(12): base is a locked nucleic acid
tggaggyttatyaargta

SEQ ID NO: 12810 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (15)..(15): base is a locked nucleic acid
tggaggyttatyaargta

SEQ ID NO: 12811 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (16)..(16): base is a locked nucleic acid
tggaggyttatyaargta

SEQ ID NO: 12812 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
ttggaggyttatyaargt

SEQ ID NO: 12813 - DNA, 18 bp, Artificial Sequence
  Oligonucleotide probe
  misc_binding (1)..(18): Hybridization probe for the specific detection of mutant HIV-1 at codon 53 of the protease gene.
  modified_base (6)..(6): base is a locked nucleic acid
ttggaggyttatyaargt

SEQ ID NO: 12814 - DNA, 18 bp, Artificial Sequence
  Oligonucleotide probe
  misc_binding (1)..(18): Hybridization probe for the specific detection of mutant HIV-1 at codon 53 of the protease gene.
  modified_base (8)..(8): base is a locked nucleic acid
ttggaggyttatyaargt

SEQ ID NO: 12815 - DNA, 18 bp, Artificial Sequence
  Oligonucleotide probe
  misc_binding (1)..(18): Hybridization probe for the specific detection of mutant HIV-1 at codon 53 of the protease gene.
  modified_base (7)..(7): base is a locked nucleic acid
ttggaggyttatyaargt

SEQ ID NO: 12816 - DNA, 18 bp, Artificial Sequence
  Oligonucleotide probe
  misc_binding (1)..(18): Hybridization probe for the specific detection of mutant HIV-1 at codon 53 of the protease gene.
  modified_base (3)..(3): base is a locked nucleic acid
ttggaggyttatyaargt

SEQ ID NO: 12817 - DNA, 18 bp, Artificial Sequence
  Oligonucleotide probe
  misc_binding (1)..(18): Hybridization probe for the specific detection of mutant HIV-1 at codon 53 of the protease gene.
  modified_base (16)..(16): base is a locked nucleic acid
ttggaggyttatyaargt

SEQ ID NO: 12818 - DNA, 18 bp, Artificial Sequence
  Oligonucleotide probe
  misc_binding (1)..(18): Hybridization probe for the specific detection of mutant HIV-1 at codon 53 of the protease gene.
  modified_base (17)..(17): base is a locked nucleic acid
ttggaggyttatyaargt

SEQ ID NO: 12819 - DNA, 18 bp, Artificial Sequence
  Oligonucleotide probe
  misc_binding (1)..(18): Hybridization probe for the specific detection of mutant HIV-1 at codon 53 of the protease gene.
  modified_base (11)..(11): base is a locked nucleic acid
ttggaggyttatyaargt

SEQ ID NO: 12820 - DNA, 18 bp, Artificial Sequence
  Oligonucleotide probe
  misc_binding (1)..(18): Hybridization probe for the specific detection of mutant HIV-1 at codon 53 of the protease gene.
  modified_base (13)..(13): base is a locked nucleic acid
ttggaggyttatyaargt

SEQ ID NO: 12821 - DNA, 18 bp, Artificial Sequence
  Oligonucleotide probe
  misc_binding (1)..(18): Hybridization probe for the specific detection of mutant HIV-1 at codon 53 of the protease gene.
  modified_base (2)..(2): base is a locked nucleic acid
  modified_base (9)..(9): base is a locked nucleic acid
  modified_base (10)..(10): base is a locked nucleic acid
ttggaggyttatyaargt

SEQ ID NO: 12822 - DNA, 18 bp, Artificial Sequence
  Oligonucleotide probe
  misc_binding (1)..(18): Hybridization probe for the specific detection of mutant HIV-1 at codon 53 of the protease gene.
  modified_base (7)..(7): base is a locked nucleic acid
  modified_base (9)..(9): base is a locked nucleic acid
  modified_base (10)..(10): base is a locked nucleic acid
ttggaggyttatyaargt

SEQ ID NO: 12823 - DNA, 18 bp, Artificial Sequence
  Oligonucleotide probe
  misc_binding (1)..(18): Hybridization probe for the specific detection of mutant HIV-1 at codon 53 of the protease gene.
  modified_base (5)..(5): base is a locked nucleic acid
  modified_base (9)..(9): base is a locked nucleic acid
  modified_base (10)..(10): base is a locked nucleic acid
ttggaggyttatyaargt

SEQ ID NO: 12824 - DNA, 18 bp, Artificial Sequence
  Oligonucleotide probe
  misc_binding (1)..(18): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (10)..(10): base is a locked nucleic acid
ttggaggyttatyaargt

SEQ ID NO: 12825 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (15)..(15): base is a locked nucleic acid
ttggaggyttatyaargt

SEQ ID NO: 12826 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (11)..(11): base is a locked nucleic acid
ttggaggyttatyaargt

SEQ ID NO: 12827 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (17)..(17): base is a locked nucleic acid
ttggaggyttatyaargt

SEQ ID NO: 12828 - DNA, 18 bp, Artificial Sequence
  Oligonucleotide probe
  misc_binding (1)..(18): Hybridization probe for the specific detection of mutant HIV-1 at codon 53 of the protease gene.
  modified_base (9)..(9): base is a locked nucleic acid
  modified_base (10)..(10): base is a locked nucleic acid
  modified_base (14)..(14): base is a locked nucleic acid
ttggaggyttatyaargt

SEQ ID NO: 12829 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
ggaggyttatyaargta

SEQ ID NO: 12830 - DNA, 17 bp, Artificial Sequence
  Oligonucleotide probe
  misc_binding (1)..(17): Hybridization probe for the specific detection of mutant HIV-1 at codon 53 of the protease gene.
  modified_base (7)..(7): base is a locked nucleic acid
ggaggyttatyaargta

SEQ ID NO: 12831 - DNA, 17 bp, Artificial Sequence
  Oligonucleotide probe
  misc_binding (1)..(17): Hybridization probe for the specific detection of mutant HIV-1 at codon 53 of the protease gene.
  modified_base (1)..(1): base is a locked nucleic acid
ggaggyttatyaargta

SEQ ID NO: 12832 - DNA, 17 bp, Artificial Sequence
  Oligonucleotide probe
  misc_binding (1)..(17): Hybridization probe for the specific detection of mutant HIV-1 at codon 53 of the protease gene.
  modified_base (6)..(6): base is a locked nucleic acid
ggaggyttatyaargta

SEQ ID NO: 12833 - DNA, 17 bp, Artificial Sequence
  Oligonucleotide probe
  misc_binding (1)..(17): Hybridization probe for the specific detection of mutant HIV-1 at codon 53 of the protease gene.
  modified_base (2)..(2): base is a locked nucleic acid
ggaggyttatyaargta

SEQ ID NO: 12834 - DNA, 17 bp, Artificial Sequence
  Oligonucleotide probe
  misc_binding (1)..(17): Hybridization probe for the specific detection of mutant HIV-1 at codon 53 of the protease gene.
  modified_base (13)..(13): base is a locked nucleic acid
ggaggyttatyaargta

SEQ ID NO: 12835 - DNA, 17 bp, Artificial Sequence
  Oligonucleotide probe
  misc_binding (1)..(17): Hybridization probe for the specific detection of mutant HIV-1 at codon 53 of the protease gene.
  modified_base (15)..(15): base is a locked nucleic acid
ggaggyttatyaargta

SEQ ID NO: 12836 - DNA, 17 bp, Artificial Sequence
  Oligonucleotide probe
  misc_binding (1)..(17): Hybridization probe for the specific detection of mutant HIV-1 at codon 53 of the protease gene.
  modified_base (9)..(9): base is a locked nucleic acid
ggaggyttatyaargta

SEQ ID NO: 12837 - DNA, 17 bp, Artificial Sequence
  Oligonucleotide probe
  misc_binding (1)..(17): Hybridization probe for the specific detection of mutant HIV-1 at codon 53 of the protease gene.
  modified_base (12)..(12): base is a locked nucleic acid
ggaggyttatyaargta

SEQ ID NO: 12838 - DNA, 17 bp, Artificial Sequence
  Oligonucleotide probe
  misc_binding (1)..(17): Hybridization probe for the specific detection of mutant HIV-1 at codon 53 of the protease gene.
  modified_base (4)..(4): base is a locked nucleic acid
  modified_base (8)..(8): base is a locked nucleic acid
  modified_base (9)..(9): base is a locked nucleic acid
ggaggyttatyaargta

SEQ ID NO: 12839 - DNA, 17 bp, Artificial Sequence
  Oligonucleotide probe
  misc_binding (1)..(17): Hybridization probe for the specific detection of mutant HIV-1 at codon 53 of the protease gene.
  modified_base (2)..(2): base is a locked nucleic acid
  modified_base (8)..(8): base is a locked nucleic acid
  modified_base (9)..(9): base is a locked nucleic acid
ggaggyttatyaargta

SEQ ID NO: 12840 - DNA, 17 bp, Artificial Sequence
  Oligonucleotide probe
  misc_binding (1)..(17): Hybridization probe for the specific detection of mutant HIV-1 at codon 53 of the protease gene.
  modified_base (7)..(7): base is a locked nucleic acid
  modified_base (8)..(8): base is a locked nucleic acid
  modified_base (9)..(9): base is a locked nucleic acid
ggaggyttatyaargta

SEQ ID NO: 12841 - DNA, 17 bp, Artificial Sequence
  Oligonucleotide probe
  misc_binding (1)..(17): Hybridization probe for the specific detection of mutant HIV-1 at codon 53 of the protease gene.
  modified_base (3)..(3): base is a locked nucleic acid
  modified_base (8)..(8): base is a locked nucleic acid
  modified_base (9)..(9): base is a locked nucleic acid
ggaggyttatyaargta

SEQ ID NO: 12842 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (12)..(12): base is a locked nucleic acid
ggaggyttatyaargta

SEQ ID NO: 12843 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (11)..(11): base is a locked nucleic acid
ggaggyttatyaargta

SEQ ID NO: 12844 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (14)..(14): base is a locked nucleic acid
ggaggyttatyaargta

SEQ ID NO: 12845 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (15)..(15): base is a locked nucleic acid
ggaggyttatyaargta

SEQ ID NO: 12846 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
tggaggyttatyaargt

SEQ ID NO: 12847 - DNA, 17 bp, Artificial Sequence
  Oligonucleotide probe
  misc_binding (1)..(17): Hybridization probe for the specific detection of mutant HIV-1 at codon 53 of the protease gene.
  modified_base (5)..(5): base is a locked nucleic acid
tggaggyttatyaargt

SEQ ID NO: 12848 - DNA, 17 bp, Artificial Sequence
  Oligonucleotide probe
  misc_binding (1)..(17): Hybridization probe for the specific detection of mutant HIV-1 at codon 53 of the protease gene.
  modified_base (7)..(7): base is a locked nucleic acid
tggaggyttatyaargt

SEQ ID NO: 12849 - DNA, 17 bp, Artificial Sequence
  Oligonucleotide probe
  misc_binding (1)..(17): Hybridization probe for the specific detection of mutant HIV-1 at codon 53 of the protease gene.
  modified_base (6)..(6): base is a locked nucleic acid
tggaggyttatyaargt

SEQ ID NO: 12850 - DNA, 17 bp, Artificial Sequence
  Oligonucleotide probe
  misc_binding (1)..(17): Hybridization probe for the specific detection of mutant HIV-1 at codon 53 of the protease gene.
  modified_base (2)..(2): base is a locked nucleic acid
tggaggyttatyaargt

SEQ ID NO: 12851 - DNA, 17 bp, Artificial Sequence
  Oligonucleotide probe
  misc_binding (1)..(17): Hybridization probe for the specific detection of mutant HIV-1 at codon 53 of the protease gene.
  modified_base (15)..(15): base is a locked nucleic acid
tggaggyttatyaargt

SEQ ID NO: 12852 - DNA, 17 bp, Artificial Sequence
  Oligonucleotide probe
  misc_binding (1)..(17): Hybridization probe for the specific detection of mutant HIV-1 at codon 53 of the protease gene.
  modified_base (16)..(16): base is a locked nucleic acid
tggaggyttatyaargt

SEQ ID NO: 12853 - DNA, 17 bp, Artificial Sequence
  Oligonucleotide probe
  misc_binding (1)..(17): Hybridization probe for the specific detection of mutant HIV-1 at codon 53 of the protease gene.
  modified_base (10)..(10): base is a locked nucleic acid
tggaggyttatyaargt

SEQ ID NO: 12854 - DNA, 17 bp, Artificial Sequence
  Oligonucleotide probe
  misc_binding (1)..(17): Hybridization probe for the specific detection of mutant HIV-1 at codon 53 of the protease gene.
  modified_base (12)..(12): base is a locked nucleic acid
tggaggyttatyaargt

SEQ ID NO: 12855 - DNA, 17 bp, Artificial Sequence
  Oligonucleotide probe
  misc_binding (1)..(17): Hybridization probe for the specific detection of mutant HIV-1 at codon 53 of the protease gene.
  modified_base (1)..(1): base is a locked nucleic acid
  modified_base (8)..(8): base is a locked nucleic acid
  modified_base (9)..(9): base is a locked nucleic acid
tggaggyttatyaargt

SEQ ID NO: 12856 - DNA, 17 bp, Artificial Sequence
  Oligonucleotide probe
  misc_binding (1)..(17): Hybridization probe for the specific detection of mutant HIV-1 at codon 53 of the protease gene.
  modified_base (6)..(6): base is a locked nucleic acid
  modified_base (8)..(8): base is a locked nucleic acid
  modified_base (9)..(9): base is a locked nucleic acid
tggaggyttatyaargt

SEQ ID NO: 12857 - DNA, 17 bp, Artificial Sequence
  Oligonucleotide probe
  misc_binding (1)..(17): Hybridization probe for the specific detection of mutant HIV-1 at codon 53 of the protease gene.
  modified_base (4)..(4): base is a locked nucleic acid
  modified_base (8)..(8): base is a locked nucleic acid
  modified_base (9)..(9): base is a locked nucleic acid
tggaggyttatyaargt

SEQ ID NO: 12858 - DNA, 17 bp, Artificial Sequence
  Oligonucleotide probe
  misc_binding (1)..(17): Hybridization probe for the specific detection of mutant HIV-1 at codon 53 of the protease gene.
  modified_base (7)..(7): base is a locked nucleic acid
  modified_base (8)..(8): base is a locked nucleic acid
  modified_base (9)..(9): base is a locked nucleic acid
tggaggyttatyaargt

SEQ ID NO: 12859 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (14)..(14): base is a locked nucleic acid
tggaggyttatyaargt

SEQ ID NO: 12860 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (10)..(10): base is a locked nucleic acid
tggaggyttatyaargt

SEQ ID NO: 12861 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (16)..(16): base is a locked nucleic acid
tggaggyttatyaargt

SEQ ID NO: 12862 - DNA, 17 bp, Artificial Sequence
  Oligonucleotide probe
  misc_binding (1)..(17): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (13)..(13): base is a locked nucleic acid
tggaggyttatyaargt

SEQ ID NO: 12863 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
ggaggyttatyaarg

SEQ ID NO: 12864 - DNA, 15 bp, Artificial Sequence
  Oligonucleotide probe
  misc_binding (1)..(15): Hybridization probe for the specific detection of mutant HIV-1 at codon 53 of the protease gene.
  modified_base (7)..(7): base is a locked nucleic acid
ggaggyttatyaarg

SEQ ID NO: 12865 - DNA, 15 bp, Artificial Sequence
  Oligonucleotide probe
  misc_binding (1)..(15): Hybridization probe for the specific detection of mutant HIV-1 at codon 53 of the protease gene.
  modified_base (1)..(1): base is a locked nucleic acid
ggaggyttatyaarg

SEQ ID NO: 12866 - DNA, 15 bp, Artificial Sequence
  Oligonucleotide probe
  misc_binding (1)..(15): Hybridization probe for the specific detection of mutant HIV-1 at codon 53 of the protease gene.
  modified_base (6)..(6): base is a locked nucleic acid
ggaggyttatyaarg

SEQ ID NO: 12867 - DNA, 15 bp, Artificial Sequence
  Oligonucleotide probe
  misc_binding (1)..(15): Hybridization probe for the specific detection of mutant HIV-1 at codon 53 of the protease gene.
  modified_base (2)..(2): base is a locked nucleic acid
ggaggyttatyaarg

SEQ ID NO: 12868 - DNA, 15 bp, Artificial Sequence
  Oligonucleotide probe
  misc_binding (1)..(15): Hybridization probe for the specific detection of mutant HIV-1 at codon 53 of the protease gene.
  modified_base (13)..(13): base is a locked nucleic acid
ggaggyttatyaarg

SEQ ID NO: 12869 - DNA, 15 bp, Artificial Sequence
  Oligonucleotide probe
  misc_binding (1)..(15): Hybridization probe for the specific detection of mutant HIV-1 at codon 53 of the protease gene.
  modified_base (15)..(15): base is a locked nucleic acid
ggaggyttatyaarg

SEQ ID NO: 12870 - DNA, 15 bp, Artificial Sequence
  Oligonucleotide probe
  misc_binding (1)..(15): Hybridization probe for the specific detection of mutant HIV-1 at codon 53 of the protease gene.
  modified_base (9)..(9): base is a locked nucleic acid
ggaggyttatyaarg

SEQ ID NO: 12871 - DNA, 15 bp, Artificial Sequence
  Oligonucleotide probe
  misc_binding (1)..(15): Hybridization probe for the specific detection of mutant HIV-1 at codon 53 of the protease gene.
  modified_base (12)..(12): base is a locked nucleic acid
ggaggyttatyaarg

SEQ ID NO: 12872 - DNA, 15 bp, Artificial Sequence
  Oligonucleotide probe
  misc_binding (1)..(15): Hybridization probe for the specific detection of mutant HIV-1 at codon 53 of the protease gene.
  modified_base (4)..(4): base is a locked nucleic acid
  modified_base (8)..(8): base is a locked nucleic acid
  modified_base (9)..(9): base is a locked nucleic acid
ggaggyttatyaarg

SEQ ID NO: 12873 - DNA, 15 bp, Artificial Sequence
  Oligonucleotide probe
  misc_binding (1)..(15): Hybridization probe for the specific detection of mutant HIV-1 at codon 53 of the protease gene.
  modified_base (2)..(2): base is a locked nucleic acid
  modified_base (8)..(8): base is a locked nucleic acid
  modified_base (9)..(9): base is a locked nucleic acid
ggaggyttatyaarg

SEQ ID NO: 12874 - DNA, 15 bp, Artificial Sequence
  Oligonucleotide probe
  misc_binding (1)..(15): Hybridization probe for the specific detection of mutant HIV-1 at codon 53 of the protease gene.
  modified_base (7)..(7): base is a locked nucleic acid
  modified_base (8)..(8): base is a locked nucleic acid
  modified_base (9)..(9): base is a locked nucleic acid
ggaggyttatyaarg

SEQ ID NO: 12875 - DNA, 15 bp, Artificial Sequence
  Oligonucleotide probe
  misc_binding (1)..(15): Hybridization probe for the specific detection of mutant HIV-1 at codon 53 of the protease gene.
  modified_base (3)..(3): base is a locked nucleic acid
  modified_base (8)..(8): base is a locked nucleic acid
  modified_base (9)..(9): base is a locked nucleic acid
ggaggyttatyaarg

SEQ ID NO: 12876 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (12)..(12): base is a locked nucleic acid
ggaggyttatyaarg

SEQ ID NO: 12877 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (11)..(11): base is a locked nucleic acid
ggaggyttatyaarg

SEQ ID NO: 12878 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (14)..(14): base is a locked nucleic acid
ggaggyttatyaarg

SEQ ID NO: 12879 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (15)..(15): base is a locked nucleic acid
ggaggyttatyaarg

SEQ ID NO: 12880 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
tggaggyttatyaar

SEQ ID NO: 12881 - DNA, 15 bp, Artificial Sequence
  Oligonucleotide probe
  misc_binding (1)..(15): Hybridization probe for the specific detection of mutant HIV-1 at codon 53 of the protease gene.
  modified_base (5)..(5): base is a locked nucleic acid
tggaggyttatyaar

SEQ ID NO: 12882 - DNA, 15 bp, Artificial Sequence
  Oligonucleotide probe
  misc_binding (1)..(15): Hybridization probe for the specific detection of mutant HIV-1 at codon 53 of the protease gene.
  modified_base (7)..(7): base is a locked nucleic acid
tggaggyttatyaar

SEQ ID NO: 12883 - DNA, 15 bp, Artificial Sequence
  Oligonucleotide probe
  misc_binding (1)..(15): Hybridization probe for the specific detection of mutant HIV-1 at codon 53 of the protease gene.
  modified_base (6)..(6): base is a locked nucleic acid
tggaggyttatyaar

SEQ ID NO: 12884 - DNA, 15 bp, Artificial Sequence
  Oligonucleotide probe
  misc_binding (1)..(15): Hybridization probe for the specific detection of mutant HIV-1 at codon 53 of the protease gene.
  modified_base (2)..(2): base is a locked nucleic acid
tggaggyttatyaar

SEQ ID NO: 12885 - DNA, 15 bp, Artificial Sequence
  Oligonucleotide probe
  misc_binding (1)..(15): Hybridization probe for the specific detection of mutant HIV-1 at codon 53 of the protease gene.
  modified_base (15)..(15): base is a locked nucleic acid
tggaggyttatyaar

SEQ ID NO: 12886 - DNA, 15 bp, Artificial Sequence
  Oligonucleotide probe
  misc_binding (1)..(15): Hybridization probe for the specific detection of mutant HIV-1 at codon 53 of the protease gene.
tggaggyttatyaar

SEQ ID NO: 12887 - DNA, 15 bp, Artificial Sequence
  Oligonucleotide probe
  misc_binding (1)..(15): Hybridization probe for the specific detection of mutant HIV-1 at codon 53 of the protease gene.
  modified_base (10)..(10): base is a locked nucleic acid
tggaggyttatyaar

SEQ ID NO: 12888 - DNA, 15 bp, Artificial Sequence
  Oligonucleotide probe
  misc_binding (1)..(15): Hybridization probe for the specific detection of mutant HIV-1 at codon 53 of the protease gene.
  modified_base (12)..(12): base is a locked nucleic acid
tggaggyttatyaar

SEQ ID NO: 12889 - DNA, 15 bp, Artificial Sequence
  Oligonucleotide probe
  misc_binding (1)..(15): Hybridization probe for the specific detection of mutant HIV-1 at codon 53 of the protease gene.
  modified_base (1)..(1): base is a locked nucleic acid
  modified_base (8)..(8): base is a locked nucleic acid
  modified_base (9)..(9): base is a locked nucleic acid
tggaggyttatyaar

SEQ ID NO: 12890 - DNA, 15 bp, Artificial Sequence
  Oligonucleotide probe
  misc_binding (1)..(15): Hybridization probe for the specific detection of mutant HIV-1 at codon 53 of the protease gene.
  modified_base (6)..(6): base is a locked nucleic acid
  modified_base (8)..(8): base is a locked nucleic acid
  modified_base (9)..(9): base is a locked nucleic acid
tggaggyttatyaar

SEQ ID NO: 12891 - DNA, 15 bp, Artificial Sequence
  Oligonucleotide probe
  misc_binding (1)..(15): Hybridization probe for the specific detection of mutant HIV-1 at codon 53 of the protease gene.
  modified_base (4)..(4): base is a locked nucleic acid
  modified_base (8)..(8): base is a locked nucleic acid
  modified_base (9)..(9): base is a locked nucleic acid
tggaggyttatyaar

SEQ ID NO: 12892 - DNA, 15 bp, Artificial Sequence
  Oligonucleotide probe
  misc_binding (1)..(15): Hybridization probe for the specific detection of mutant HIV-1 at codon 53 of the protease gene.
  modified_base (7)..(7): base is a locked nucleic acid
  modified_base (8)..(8): base is a locked nucleic acid
  modified_base (9)..(9): base is a locked nucleic acid
tggaggyttatyaar

SEQ ID NO: 12893 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (14)..(14): base is a locked nucleic acid
tggaggyttatyaar

SEQ ID NO: 12894 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (10)..(10): base is a locked nucleic acid
tggaggyttatyaar

SEQ ID NO: 12895 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
tggaggyttatyaar

SEQ ID NO: 12896 - DNA, 15 bp, Artificial Sequence
  Oligonucleotide probe
  misc_binding (1)..(15): Hybridization probe for the specific detection of mutant HIV-1 at codon 53 of the protease gene.
  modified_base (8)..(8): base is a locked nucleic acid
  modified_base (9)..(9): base is a locked nucleic acid
  modified_base (13)..(13): base is a locked nucleic acid
tggaggyttatyaar

SEQ ID NO: 12897 - DNA, 15 bp, Artificial Sequence
  Oligonucleotide probe
  misc_binding (1)..(15): Hybridization probe for the specific detection of mutant HIV-1 at codon 53 of the protease gene.
tttgatragacctcc

SEQ ID NO: 12898 - DNA, 15 bp, Artificial Sequence
  Oligonucleotide probe
  misc_binding (1)..(15): Hybridization probe for the specific detection of mutant HIV-1 at codon 53 of the protease gene.
tttgatyaaacctcc

SEQ ID NO: 12899 - DNA, 15 bp, Artificial Sequence
  Oligonucleotide probe
  misc_binding (1)..(15): Hybridization probe for the specific detection of mutant HIV-1 at codon 53 of the protease gene.
tttgatrtaacctcc

SEQ ID NO: 12900 - DNA, 19 bp, Artificial Sequence
  Oligonucleotide probe
  misc_binding (1)..(19): Hybridization probe for the specific detection of mutant HIV-1 at codon 53 of the protease gene.
tggaggyttatyaargtaa

SEQ ID NO: 12901 - DNA, 19 bp, Artificial Sequence
  Oligonucleotide probe
  misc_binding (1)..(19): Hybridization probe for the specific detection of mutant HIV-1 at codon 53 of the protease gene.
ttggaggyttatyaargta

SEQ ID NO: 12902 - DNA, 18 bp, Artificial Sequence
  Oligonucleotide probe
  misc_binding (1)..(18): Hybridization probe for the specific detection of mutant HIV-1 at codon 53 of the protease gene.
tggaggyttatyaargta

SEQ ID NO: 12903 - DNA, 18 bp, Artificial Sequence
  Oligonucleotide probe
  misc_binding (1)..(18): Hybridization probe for the specific detection of mutant HIV-1 at codon 53 of the protease gene.
ttggaggyttatyaargt

SEQ ID NO: 12904 - DNA, 17 bp, Artificial Sequence
  Oligonucleotide probe
  misc_binding (1)..(17): Hybridization probe for the specific detection of mutant HIV-1 at codon 53 of the protease gene.
ggaggyttatyaargta

SEQ ID NO: 12905 - DNA, 17 bp, Artificial Sequence
  Oligonucleotide probe
  misc_binding (1)..(17): Hybridization probe for the specific detection of mutant HIV-1 at codon 53 of the protease gene.
tggaggyttatyaargt

SEQ ID NO: 12906 - DNA, 15 bp, Artificial Sequence
  Oligonucleotide probe
  misc_binding (1)..(15): Hybridization probe for the specific detection of mutant HIV-1 at codon 53 of the protease gene.
ggaggyttatyaarg

SEQ ID NO: 12907 - DNA, 15 bp, Artificial Sequence
  Oligonucleotide probe
  misc_binding (1)..(15): Hybridization probe for the specific detection of mutant HIV-1 at codon 53 of the protease gene.
tggaggyttatyaar

SEQ ID NO: 12908 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
aggytttataargtaarrc

SEQ ID NO: 12909 - DNA, 19 bp, Artificial Sequence
  Oligonucleotide probe
  misc_binding (1)..(19): Hybridization probe for the specific detection of mutant HIV-1 at codon 54 of the protease gene.
  modified_base (6)..(6): base is a locked nucleic acid
aggytttataargtaarrc

SEQ ID NO: 12910 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
aggytttataargtaarrc

SEQ ID NO: 12911 - DNA, 19 bp, Artificial Sequence
  Oligonucleotide probe
  misc_binding (1)..(19): Hybridization probe for the specific detection of mutant HIV-1 at codon 54 of the protease gene.
  modified_base (7)..(7): base is a locked nucleic acid
aggytttataargtaarrc

SEQ ID NO: 12912 - DNA, 19 bp, Artificial Sequence
  Oligonucleotide probe
  misc_binding (1)..(19): Hybridization probe for the specific detection of mutant HIV-1 at codon 54 of the protease gene.
  modified_base (8)..(8): base is a locked nucleic acid
aggytttataargtaarrc

SEQ ID NO: 12913 - DNA, 19 bp, Artificial Sequence
  Oligonucleotide probe
  misc_binding (1)..(19): Hybridization probe for the specific detection of mutant HIV-1 at codon 54 of the protease gene.
  modified_base (10)..(10): base is a locked nucleic acid
aggytttataargtaarrc

SEQ ID NO: 12914 - DNA, 19 bp, Artificial Sequence
  Oligonucleotide probe
  misc_binding (1)..(19): Hybridization probe for the specific detection of mutant HIV-1 at codon 54 of the protease gene.
  modified_base (14)..(14): base is a locked nucleic acid
aggytttataargtaarrc

SEQ ID NO: 12915 - DNA, 19 bp, Artificial Sequence
  Oligonucleotide probe
  misc_binding (1)..(19): Hybridization probe for the specific detection of mutant HIV-1 at codon 54 of the protease gene.
  modified_base (16)..(16): base is a locked nucleic acid
aggytttataargtaarrc

SEQ ID NO: 12916 - DNA, 19 bp, Artificial Sequence
  Oligonucleotide probe
  misc_binding (1)..(19): Hybridization probe for the specific detection of mutant HIV-1 at codon 54 of the protease gene.
  modified_base (12)..(12): base is a locked nucleic acid
aggytttataargtaarrc

SEQ ID NO: 12917 - DNA, 19 bp, Artificial Sequence
  Oligonucleotide probe
  misc_binding (1)..(19): Hybridization probe for the specific detection of mutant HIV-1 at codon 54 of the protease gene.
  modified_base (6)..(6): base is a locked nucleic acid
  modified_base (9)..(9): base is a locked nucleic acid
  modified_base (10)..(10): base is a locked nucleic acid
aggytttataargtaarrc

SEQ ID NO: 12918 - DNA, 19 bp, Artificial Sequence
  Oligonucleotide probe
  misc_binding (1)..(19): Hybridization probe for the specific detection of mutant HIV-1 at codon 54 of the protease gene.
  modified_base (5)..(5): base is a locked nucleic acid
  modified_base (9)..(9): base is a locked nucleic acid
  modified_base (10)..(10): base is a locked nucleic acid
aggytttataargtaarrc

SEQ ID NO: 12919 - DNA, 19 bp, Artificial Sequence
  Oligonucleotide probe
  misc_binding (1)..(19): Hybridization probe for the specific detection of mutant HIV-1 at codon 54 of the protease gene.
  modified_base (4)..(4): base is a locked nucleic acid
  modified_base (9)..(9): base is a locked nucleic acid
  modified_base (10)..(10): base is a locked nucleic acid
aggytttataargtaarrc

SEQ ID NO: 12920 - DNA, 19 bp, Artificial Sequence
  Oligonucleotide probe
  misc_binding (1)..(19): Hybridization probe for the specific detection of mutant HIV-1 at codon 54 of the protease gene.
  modified_base (3)..(3): base is a locked nucleic acid
  modified_base (9)..(9): base is a locked nucleic acid
  modified_base (10)..(10): base is a locked nucleic acid
aggytttataargtaarrc

SEQ ID NO: 12921 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (13)..(13): base is a locked nucleic acid
aggytttataargtaarrc

SEQ ID NO: 12922 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (18)..(18): base is a locked nucleic acid
aggytttataargtaarrc

SEQ ID NO: 12923 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (12)..(12): base is a locked nucleic acid
aggytttataargtaarrc

SEQ ID NO: 12924 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (11)..(11): base is a locked nucleic acid
aggytttataargtaarrc

SEQ ID NO: 12925 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
gaggytttayaargtaarr

SEQ ID NO: 12926 - DNA, 19 bp, Artificial Sequence
  Oligonucleotide probe
  misc_binding (1)..(19): Hybridization probe for the specific detection of mutant HIV-1 at codon 54 of the protease gene.
  modified_base (7)..(7): base is a locked nucleic acid
gaggytttayaargtaarr

SEQ ID NO: 12927 - DNA, 19 bp, Artificial Sequence
  Oligonucleotide probe
  misc_binding (1)..(19): Hybridization probe for the specific detection of mutant HIV-1 at codon 54 of the protease gene.
  modified_base (3)..(3): base is a locked nucleic acid
gaggytttayaargtaarr

SEQ ID NO: 12928 - DNA, 19 bp, Artificial Sequence
  Oligonucleotide probe
  misc_binding (1)..(19): Hybridization probe for the specific detection of mutant HIV-1 at codon 54 of the protease gene.
  modified_base (8)..(8): base is a locked nucleic acid
gaggytttayaargtaarr

SEQ ID NO: 12929 - DNA, 19 bp, Artificial Sequence
  Oligonucleotide probe
  misc_binding (1)..(19): Hybridization probe for the specific detection of mutant HIV-1 at codon 54 of the protease gene.
  modified_base (4)..(4): base is a locked nucleic acid
gaggytttayaargtaarr

SEQ ID NO: 12930 - DNA, 19 bp, Artificial Sequence
  Oligonucleotide probe
  misc_binding (1)..(19): Hybridization probe for the specific detection of mutant HIV-1 at codon 54 of the protease gene.
  modified_base (10)..(10): base is a locked nucleic acid
gaggytttayaargtaarr

SEQ ID NO: 12931 - DNA, 19 bp, Artificial Sequence
  Oligonucleotide probe
  misc_binding (1)..(19): Hybridization probe for the specific detection of mutant HIV-1 at codon 54 of the protease gene.
  modified_base (13)..(13): base is a locked nucleic acid
gaggytttayaargtaarr

SEQ ID NO: 12932 - DNA, 19 bp, Artificial Sequence
  Oligonucleotide probe
  misc_binding (1)..(19): Hybridization probe for the specific detection of mutant HIV-1 at codon 54 of the protease gene.
  modified_base (16)..(16): base is a locked nucleic acid
gaggytttayaargtaarr

SEQ ID NO: 12933 - DNA, 19 bp, Artificial Sequence
  Oligonucleotide probe
  misc_binding (1)..(19): Hybridization probe for the specific detection of mutant HIV-1 at codon 54 of the protease gene.
  modified_base (11)..(11): base is a locked nucleic acid
gaggytttayaargtaarr

SEQ ID NO: 12934 - DNA, 19 bp, Artificial Sequence
  Oligonucleotide probe
  misc_binding (1)..(19): Hybridization probe for the specific detection of mutant HIV-1 at codon 54 of the protease gene.
  modified_base (7)..(7): base is a locked nucleic acid
  modified_base (9)..(9): base is a locked nucleic acid
  modified_base (10)..(10): base is a locked nucleic acid
gaggytttayaargtaarr

SEQ ID NO: 12935 - DNA, 19 bp, Artificial Sequence
  Oligonucleotide probe
  misc_binding (1)..(19): Hybridization probe for the specific detection of mutant HIV-1 at codon 54 of the protease gene.
  modified_base (4)..(4): base is a locked nucleic acid
  modified_base (9)..(9): base is a locked nucleic acid
  modified_base (10)..(10): base is a locked nucleic acid
gaggytttayaargtaarr

SEQ ID NO: 12936 - DNA, 19 bp, Artificial Sequence
  Oligonucleotide probe
  misc_binding (1)..(19): Hybridization probe for the specific detection of mutant HIV-1 at codon 54 of the protease gene.
  modified_base (3)..(3): base is a locked nucleic acid
  modified_base (9)..(9): base is a locked nucleic acid
  modified_base (10)..(10): base is a locked nucleic acid
gaggytttayaargtaarr

SEQ ID NO: 12937 - DNA, 19 bp, Artificial Sequence
  Oligonucleotide probe
  misc_binding (1)..(19): Hybridization probe for the specific detection of mutant HIV-1 at codon 54 of the protease gene.
  modified_base (5)..(5): base is a locked nucleic acid
  modified_base (9)..(9): base is a locked nucleic acid
  modified_base (10)..(10): base is a locked nucleic acid
gaggytttayaargtaarr

SEQ ID NO: 12938 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (16)..(16): base is a locked nucleic acid
gaggytttayaargtaarr

SEQ ID NO: 12939 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (15)..(15): base is a locked nucleic acid
gaggytttayaargtaarr

SEQ ID NO: 12940 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (13)..(13): base is a locked nucleic acid
gaggytttayaargtaarr

SEQ ID NO: 12941 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (11)..(11): base is a locked nucleic acid
gaggytttayaargtaarr

SEQ ID NO: 12942 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
ggaggyttttyaargtaar

SEQ ID NO: 12943 - DNA, 19 bp, Artificial Sequence
  Oligonucleotide probe
  misc_binding (1)..(19): Hybridization probe for the specific detection of mutant HIV-1 at codon 54 of the protease gene.
  modified_base (4)..(4): base is a locked nucleic acid
ggaggyttttyaargtaar

SEQ ID NO: 12944 - DNA, 19 bp, Artificial Sequence
  Oligonucleotide probe
  misc_binding (1)..(19): Hybridization probe for the specific detection of mutant HIV-1 at codon 54 of the protease gene.
  modified_base (2)..(2): base is a locked nucleic acid
ggaggyttttyaargtaar

SEQ ID NO: 12945 - DNA, 19 bp, Artificial Sequence
  Oligonucleotide probe
  misc_binding (1)..(19): Hybridization probe for the specific detection of mutant HIV-1 at codon 54 of the protease gene.
  modified_base (3)..(3): base is a locked nucleic acid
ggaggyttttyaargtaar

SEQ ID NO: 12946 - DNA, 19 bp, Artificial Sequence
  Oligonucleotide probe
  misc_binding (1)..(19): Hybridization probe for the specific detection of mutant HIV-1 at codon 54 of the protease gene.
  modified_base (7)..(7): base is a locked nucleic acid
ggaggyttttyaargtaar

SEQ ID NO: 12947 - DNA, 19 bp, Artificial Sequence
  Oligonucleotide probe
  misc_binding (1)..(19): Hybridization probe for the specific detection of mutant HIV-1 at codon 54 of the protease gene.
  modified_base (12)..(12): base is a locked nucleic acid
ggaggyttttyaargtaar

SEQ ID NO: 12948 - DNA, 19 bp, Artificial Sequence
  Oligonucleotide probe
  misc_binding (1)..(19): Hybridization probe for the specific detection of mutant HIV-1 at codon 54 of the protease gene.
  modified_base (17)..(17): base is a locked nucleic acid
ggaggyttttyaargtaar

SEQ ID NO: 12949 - DNA, 19 bp, Artificial Sequence
  Oligonucleotide probe
  misc_binding (1)..(19): Hybridization probe for the specific detection of mutant HIV-1 at codon 54 of the protease gene.
  modified_base (16)..(16): base is a locked nucleic acid
ggaggyttttyaargtaar

SEQ ID NO: 12950 - DNA, 19 bp, Artificial Sequence
  Oligonucleotide probe
  misc_binding (1)..(19): Hybridization probe for the specific detection of mutant HIV-1 at codon 54 of the protease gene.
  modified_base (18)..(18): base is a locked nucleic acid
ggaggyttttyaargtaar

SEQ ID NO: 12951 - DNA, 19 bp, Artificial Sequence
  Oligonucleotide probe
  misc_binding (1)..(19): Hybridization probe for the specific detection of mutant HIV-1 at codon 54 of the protease gene.
  modified_base (3)..(3): base is a locked nucleic acid
  modified_base (9)..(9): base is a locked nucleic acid
  modified_base (10)..(10): base is a locked nucleic acid
ggaggyttttyaargtaar

SEQ ID NO: 12952 - DNA, 19 bp, Artificial Sequence
  Oligonucleotide probe
  misc_binding (1)..(19): Hybridization probe for the specific detection of mutant HIV-1 at codon 54 of the protease gene.
  modified_base (2)..(2): base is a locked nucleic acid
  modified_base (9)..(9): base is a locked nucleic acid
  modified_base (10)..(10): base is a locked nucleic acid
ggaggyttttyaargtaar

SEQ ID NO: 12953 - DNA, 19 bp, Artificial Sequence
  Oligonucleotide probe
  misc_binding (1)..(19): Hybridization probe for the specific detection of mutant HIV-1 at codon 54 of the protease gene.
  modified_base (7)..(7): base is a locked nucleic acid
  modified_base (9)..(9): base is a locked nucleic acid
  modified_base (10)..(10): base is a locked nucleic acid
ggaggyttttyaargtaar

SEQ ID NO: 12954 - DNA, 19 bp, Artificial Sequence
  Oligonucleotide probe
  misc_binding (1)..(19): Hybridization probe for the specific detection of mutant HIV-1 at codon 54 of the protease gene.
  modified_base (4)..(4): base is a locked nucleic acid
  modified_base (9)..(9): base is a locked nucleic acid
  modified_base (10)..(10): base is a locked nucleic acid
ggaggyttttyaargtaar

SEQ ID NO: 12955 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (14)..(14): base is a locked nucleic acid
ggaggyttttyaargtaar

SEQ ID NO: 12956 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (13)..(13): base is a locked nucleic acid
ggaggyttttyaargtaar

SEQ ID NO: 12957 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (15)..(15): base is a locked nucleic acid
ggaggyttttyaargtaar

SEQ ID NO: 12958 - DNA, 19 bp, Artificial Sequence
  Oligonucleotide probe
  misc_binding (1)..(19): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (12)..(12): base is a locked nucleic acid
ggaggyttttyaargtaar

SEQ ID NO: 12959 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
aggytttataargtaarr

SEQ ID NO: 12960 - DNA, 18 bp, Artificial Sequence
  Oligonucleotide probe
  misc_binding (1)..(18): Hybridization probe for the specific detection of mutant HIV-1 at codon 54 of the protease gene.
  modified_base (6)..(6): base is a locked nucleic acid
aggytttataargtaarr

SEQ ID NO: 12961 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
aggytttataargtaarr

SEQ ID NO: 12962 - DNA, 18 bp, Artificial Sequence
  Oligonucleotide probe
  misc_binding (1)..(18): Hybridization probe for the specific detection of mutant HIV-1 at codon 54 of the protease gene.
  modified_base (7)..(7): base is a locked nucleic acid
aggytttataargtaarr

SEQ ID NO: 12963 - DNA, 18 bp, Artificial Sequence
  Oligonucleotide probe
  misc_binding (1)..(18): Hybridization probe for the specific detection of mutant HIV-1 at codon 54 of the protease gene.
  modified_base (8)..(8): base is a locked nucleic acid
aggytttataargtaarr

SEQ ID NO: 12964 - DNA, 18 bp, Artificial Sequence
  Oligonucleotide probe
  misc_binding (1)..(18): Hybridization probe for the specific detection of mutant HIV-1 at codon 54 of the protease gene.
  modified_base (10)..(10): base is a locked nucleic acid
aggytttataargtaarr

SEQ ID NO: 12965 - DNA, 18 bp, Artificial Sequence
  Oligonucleotide probe
  misc_binding (1)..(18): Hybridization probe for the specific detection of mutant HIV-1 at codon 54 of the protease gene.
  modified_base (14)..(14): base is a locked nucleic acid
aggytttataargtaarr

SEQ ID NO: 12966 - DNA, 18 bp, Artificial Sequence
  Oligonucleotide probe
  misc_binding (1)..(18): Hybridization probe for the specific detection of mutant HIV-1 at codon 54 of the protease gene.
  modified_base (16)..(16): base is a locked nucleic acid
aggytttataargtaarr

SEQ ID NO: 12967 - DNA, 18 bp, Artificial Sequence
  Oligonucleotide probe
  misc_binding (1)..(18): Hybridization probe for the specific detection of mutant HIV-1 at codon 54 of the protease gene.
  modified_base (12)..(12): base is a locked nucleic acid
aggytttataargtaarr

SEQ ID NO: 12968 - DNA, 18 bp, Artificial Sequence
  Oligonucleotide probe
  misc_binding (1)..(18): Hybridization probe for the specific detection of mutant HIV-1 at codon 54 of the protease gene.
  modified_base (6)..(6): base is a locked nucleic acid
  modified_base (9)..(9): base is a locked nucleic acid
  modified_base (10)..(10): base is a locked nucleic acid
aggytttataargtaarr

SEQ ID NO: 12969 - DNA, 18 bp, Artificial Sequence
  Oligonucleotide probe
  misc_binding (1)..(18): Hybridization probe for the specific detection of mutant HIV-1 at codon 54 of the protease gene.
  modified_base (5)..(5): base is a locked nucleic acid
  modified_base (9)..(9): base is a locked nucleic acid
  modified_base (10)..(10): base is a locked nucleic acid
aggytttataargtaarr

SEQ ID NO: 12970 - DNA, 18 bp, Artificial Sequence
  Oligonucleotide probe
  misc_binding (1)..(18): Hybridization probe for the specific detection of mutant HIV-1 at codon 54 of the protease gene.
  modified_base (4)..(4): base is a locked nucleic acid
  modified_base (9)..(9): base is a locked nucleic acid
  modified_base (10)..(10): base is a locked nucleic acid
aggytttataargtaarr

SEQ ID NO: 12971 - DNA, 18 bp, Artificial Sequence
  Oligonucleotide probe
  misc_binding (1)..(18): Hybridization probe for the specific detection of mutant HIV-1 at codon 54 of the protease gene.
  modified_base (3)..(3): base is a locked nucleic acid
  modified_base (9)..(9): base is a locked nucleic acid
  modified_base (10)..(10): base is a locked nucleic acid
aggytttataargtaarr

SEQ ID NO: 12972 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (13)..(13): base is a locked nucleic acid
aggytttataargtaarr

SEQ ID NO: 12973 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (18)..(18): base is a locked nucleic acid
aggytttataargtaarr

SEQ ID NO: 12974 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (12)..(12): base is a locked nucleic acid
aggytttataargtaarr

SEQ ID NO: 12975 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (11)..(11): base is a locked nucleic acid
aggytttataargtaarr

SEQ ID NO: 12976 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
gaggytttayaargtaar

SEQ ID NO: 12977 - DNA, 18 bp, Artificial Sequence
  Oligonucleotide probe
  misc_binding (1)..(18): Hybridization probe for the specific detection of mutant HIV-1 at codon 54 of the protease gene.
  modified_base (7)..(7): base is a locked nucleic acid
gaggytttayaargtaar

SEQ ID NO: 12978 - DNA, 18 bp, Artificial Sequence
  Oligonucleotide probe
  misc_binding (1)..(18): Hybridization probe for the specific detection of mutant HIV-1 at codon 54 of the protease gene.
  modified_base (3)..(3): base is a locked nucleic acid
gaggytttayaargtaar

SEQ ID NO: 12979 - DNA, 18 bp, Artificial Sequence
  Oligonucleotide probe
  misc_binding (1)..(18): Hybridization probe for the specific detection of mutant HIV-1 at codon 54 of the protease gene.
  modified_base (8)..(8): base is a locked nucleic acid
gaggytttayaargtaar

SEQ ID NO: 12980 - DNA, 18 bp, Artificial Sequence
  Oligonucleotide probe
  misc_binding (1)..(18): Hybridization probe for the specific detection of mutant HIV-1 at codon 54 of the protease gene.
  modified_base (4)..(4): base is a locked nucleic acid
gaggytttayaargtaar

SEQ ID NO: 12981 - DNA, 18 bp, Artificial Sequence
  Oligonucleotide probe
  misc_binding (1)..(18): Hybridization probe for the specific detection of mutant HIV-1 at codon 54 of the protease gene.
  modified_base (10)..(10): base is a locked nucleic acid
gaggytttayaargtaar

SEQ ID NO: 12982 - DNA, 18 bp, Artificial Sequence
  Oligonucleotide probe
  misc_binding (1)..(18): Hybridization probe for the specific detection of mutant HIV-1 at codon 54 of the protease gene.
  modified_base (13)..(13): base is a locked nucleic acid
gaggytttayaargtaar

SEQ ID NO: 12983 - DNA, 18 bp, Artificial Sequence
  Oligonucleotide probe
  misc_binding (1)..(18): Hybridization probe for the specific detection of mutant HIV-1 at codon 54 of the protease gene.
  modified_base (16)..(16): base is a locked nucleic acid
gaggytttayaargtaar

SEQ ID NO: 12984 - DNA, 18 bp, Artificial Sequence
  Oligonucleotide probe
  misc_binding (1)..(18): Hybridization probe for the specific detection of mutant HIV-1 at codon 54 of the protease gene.
  modified_base (11)..(11): base is a locked nucleic acid
gaggytttayaargtaar

SEQ ID NO: 12985 - DNA, 18 bp, Artificial Sequence
  Oligonucleotide probe
  misc_binding (1)..(18): Hybridization probe for the specific detection of mutant HIV-1 at codon 54 of the protease gene.
  modified_base (7)..(7): base is a locked nucleic acid
  modified_base (9)..(9): base is a locked nucleic acid
  modified_base (10)..(10): base is a locked nucleic acid
gaggytttayaargtaar

SEQ ID NO: 12986 - DNA, 18 bp, Artificial Sequence
  Oligonucleotide probe
  misc_binding (1)..(18): Hybridization probe for the specific detection of mutant HIV-1 at codon 54 of the protease gene.
  modified_base (4)..(4): base is a locked nucleic acid
  modified_base (9)..(9): base is a locked nucleic acid
  modified_base (10)..(10): base is a locked nucleic acid
gaggytttayaargtaar

SEQ ID NO: 12987 - DNA, 18 bp, Artificial Sequence
  Oligonucleotide probe
  misc_binding (1)..(18): Hybridization probe for the specific detection of mutant HIV-1 at codon 54 of the protease gene.
  modified_base (3)..(3): base is a locked nucleic acid
  modified_base (9)..(9): base is a locked nucleic acid
  modified_base (10)..(10): base is a locked nucleic acid
gaggytttayaargtaar

SEQ ID NO: 12988 - DNA, 18 bp, Artificial Sequence
  Oligonucleotide probe
  misc_binding (1)..(18): Hybridization probe for the specific detection of mutant HIV-1 at codon 54 of the protease gene.
  modified_base (5)..(5): base is a locked nucleic acid
  modified_base (9)..(9): base is a locked nucleic acid
  modified_base (10)..(10): base is a locked nucleic acid
gaggytttayaargtaar

SEQ ID NO: 12989 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (16)..(16): base is a locked nucleic acid
gaggytttayaargtaar

SEQ ID NO: 12990 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (15)..(15): base is a locked nucleic acid
gaggytttayaargtaar

SEQ ID NO: 12991 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (13)..(13): base is a locked nucleic acid
gaggytttayaargtaar

SEQ ID NO: 12992 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (11)..(11): base is a locked nucleic acid
gaggytttayaargtaar

SEQ ID NO: 12993 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
ggaggyttttyaargtaa

SEQ ID NO: 12994 - DNA, 18 bp, Artificial Sequence
  Oligonucleotide probe
  misc_binding (1)..(18): Hybridization probe for the specific detection of mutant HIV-1 at codon 54 of the protease gene.
  modified_base (4)..(4): base is a locked nucleic acid
ggaggyttttyaargtaa

SEQ ID NO: 12995 - DNA, 18 bp, Artificial Sequence
  Oligonucleotide probe
  misc_binding (1)..(18): Hybridization probe for the specific detection of mutant HIV-1 at codon 54 of the protease gene.
  modified_base (2)..(2): base is a locked nucleic acid
ggaggyttttyaargtaa

SEQ ID NO: 12996 - DNA, 18 bp, Artificial Sequence
  Oligonucleotide probe
  misc_binding (1)..(18): Hybridization probe for the specific detection of mutant HIV-1 at codon 54 of the protease gene.
  modified_base (3)..(3): base is a locked nucleic acid
ggaggyttttyaargtaa

SEQ ID NO: 12997 - DNA, 18 bp, Artificial Sequence
  Oligonucleotide probe
  misc_binding (1)..(18): Hybridization probe for the specific detection of mutant HIV-1 at codon 54 of the protease gene.
  modified_base (7)..(7): base is a locked nucleic acid
ggaggyttttyaargtaa

SEQ ID NO: 12998 - DNA, 18 bp, Artificial Sequence
  Oligonucleotide probe
  misc_binding (1)..(18): Hybridization probe for the specific detection of mutant HIV-1 at codon 54 of the protease gene.
  modified_base (12)..(12): base is a locked nucleic acid
ggaggyttttyaargtaa

SEQ ID NO: 12999 - DNA, 18 bp, Artificial Sequence
  Oligonucleotide probe
  misc_binding (1)..(18): Hybridization probe for the specific detection of mutant HIV-1 at codon 54 of the protease gene.
  modified_base (17)..(17): base is a locked nucleic acid
ggaggyttttyaargtaa

SEQ ID NO: 13000 - DNA, 18 bp, Artificial Sequence
  Oligonucleotide probe
  misc_binding (1)..(18): Hybridization probe for the specific detection of mutant HIV-1 at codon 54 of the protease gene.
  modified_base (16)..(16): base is a locked nucleic acid
ggaggyttttyaargtaa

SEQ ID NO: 13001 - DNA, 18 bp, Artificial Sequence
  Oligonucleotide probe
  misc_binding (1)..(18): Hybridization probe for the specific detection of mutant HIV-1 at codon 54 of the protease gene.
  modified_base (18)..(18): base is a locked nucleic acid
ggaggyttttyaargtaa

SEQ ID NO: 13002 - DNA, 18 bp, Artificial Sequence
  Oligonucleotide probe
  misc_binding (1)..(18): Hybridization probe for the specific detection of mutant HIV-1 at codon 54 of the protease gene.
  modified_base (3)..(3): base is a locked nucleic acid
  modified_base (9)..(9): base is a locked nucleic acid
  modified_base (10)..(10): base is a locked nucleic acid
ggaggyttttyaargtaa

SEQ ID NO: 13003 - DNA, 18 bp, Artificial Sequence
  Oligonucleotide probe
  misc_binding (1)..(18): Hybridization probe for the specific detection of mutant HIV-1 at codon 54 of the protease gene.
  modified_base (2)..(2): base is a locked nucleic acid
  modified_base (9)..(9): base is a locked nucleic acid
  modified_base (10)..(10): base is a locked nucleic acid
ggaggyttttyaargtaa

SEQ ID NO: 13004 - DNA, 18 bp, Artificial Sequence
  Oligonucleotide probe
  misc_binding (1)..(18): Hybridization probe for the specific detection of mutant HIV-1 at codon 54 of the protease gene.
  modified_base (7)..(7): base is a locked nucleic acid
  modified_base (9)..(9): base is a locked nucleic acid
  modified_base (10)..(10): base is a locked nucleic acid
ggaggyttttyaargtaa

SEQ ID NO: 13005 - DNA, 18 bp, Artificial Sequence
  Oligonucleotide probe
  misc_binding (1)..(18): Hybridization probe for the specific detection of mutant HIV-1 at codon 54 of the protease gene.
  modified_base (4)..(4): base is a locked nucleic acid
  modified_base (9)..(9): base is a locked nucleic acid
  modified_base (10)..(10): base is a locked nucleic acid
ggaggyttttyaargtaa

SEQ ID NO: 13006 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (14)..(14): base is a locked nucleic acid
ggaggyttttyaargtaa

SEQ ID NO: 13007 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (13)..(13): base is a locked nucleic acid
ggaggyttttyaargtaa

SEQ ID NO: 13008 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (15)..(15): base is a locked nucleic acid
ggaggyttttyaargtaa

SEQ ID NO: 13009 - DNA, 18 bp, Artificial Sequence
  Oligonucleotide probe
  misc_binding (1)..(18): Hybridization probe for the specific detection of mutant HIV-1 at codon 54 of the protease gene.
  modified_base (9)..(9): base is a locked nucleic acid
  modified_base (10)..(10): base is a locked nucleic acid
  modified_base (12)..(12): base is a locked nucleic acid
ggaggyttttyaargtaa

SEQ ID NO: 13010 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
ggytttataargtaarr

SEQ ID NO: 13011 - DNA, 17 bp, Artificial Sequence
  Oligonucleotide probe
  misc_binding (1)..(17): Hybridization probe for the specific detection of mutant HIV-1 at codon 54 of the protease gene.
  modified_base (5)..(5): base is a locked nucleic acid
ggytttataargtaarr

SEQ ID NO: 13012 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
ggytttataargtaarr

SEQ ID NO: 13013 - DNA, 17 bp, Artificial Sequence
  Oligonucleotide probe
  misc_binding (1)..(17): Hybridization probe for the specific detection of mutant HIV-1 at codon 54 of the protease gene.
  modified_base (6)..(6): base is a locked nucleic acid
ggytttataargtaarr

SEQ ID NO: 13014 - DNA, 17 bp, Artificial Sequence
  Oligonucleotide probe
  misc_binding (1)..(17): Hybridization probe for the specific detection of mutant HIV-1 at codon 54 of the protease gene.
  modified_base (7)..(7): base is a locked nucleic acid
ggytttataargtaarr

SEQ ID NO: 13015 - DNA, 17 bp, Artificial Sequence
  Oligonucleotide probe
  misc_binding (1)..(17): Hybridization probe for the specific detection of mutant HIV-1 at codon 54 of the protease gene.
  modified_base (9)..(9): base is a locked nucleic acid
ggytttataargtaarr

SEQ ID NO: 13016 - DNA, 17 bp, Artificial Sequence
  Oligonucleotide probe
  misc_binding (1)..(17): Hybridization probe for the specific detection of mutant HIV-1 at codon 54 of the protease gene.
  modified_base (13)..(13): base is a locked nucleic acid
ggytttataargtaarr

SEQ ID NO: 13017 - DNA, 17 bp, Artificial Sequence
  Oligonucleotide probe
  misc_binding (1)..(17): Hybridization probe for the specific detection of mutant HIV-1 at codon 54 of the protease gene.
  modified_base (15)..(15): base is a locked nucleic acid
ggytttataargtaarr

SEQ ID NO: 13018 - DNA, 17 bp, Artificial Sequence
  Oligonucleotide probe
  misc_binding (1)..(17): Hybridization probe for the specific detection of mutant HIV-1 at codon 54 of the protease gene.
  modified_base (11)..(11): base is a locked nucleic acid
ggytttataargtaarr

SEQ ID NO: 13019 - DNA, 17 bp, Artificial Sequence
  Oligonucleotide probe
  misc_binding (1)..(17): Hybridization probe for the specific detection of mutant HIV-1 at codon 54 of the protease gene.
  modified_base (5)..(5): base is a locked nucleic acid
  modified_base (8)..(8): base is a locked nucleic acid
  modified_base (9)..(9): base is a locked nucleic acid
ggytttataargtaarr

SEQ ID NO: 13020 - DNA, 17 bp, Artificial Sequence
  Oligonucleotide probe
  misc_binding (1)..(17): Hybridization probe for the specific detection of mutant HIV-1 at codon 54 of the protease gene.
  modified_base (4)..(4): base is a locked nucleic acid
  modified_base (8)..(8): base is a locked nucleic acid
  modified_base (9)..(9): base is a locked nucleic acid
ggytttataargtaarr

SEQ ID NO: 13021 - DNA, 17 bp, Artificial Sequence
  Oligonucleotide probe
  misc_binding (1)..(17): Hybridization probe for the specific detection of mutant HIV-1 at codon 54 of the protease gene.
  modified_base (3)..(3): base is a locked nucleic acid
  modified_base (8)..(8): base is a locked nucleic acid
  modified_base (9)..(9): base is a locked nucleic acid
ggytttataargtaarr

SEQ ID NO: 13022 - DNA, 17 bp, Artificial Sequence
  Oligonucleotide probe
  misc_binding (1)..(17): Hybridization probe for the specific detection of mutant HIV-1 at codon 54 of the protease gene.
  modified_base (2)..(2): base is a locked nucleic acid
  modified_base (8)..(8): base is a locked nucleic acid
  modified_base (9)..(9): base is a locked nucleic acid
ggytttataargtaarr

SEQ ID NO: 13023 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (12)..(12): base is a locked nucleic acid
ggytttataargtaarr

SEQ ID NO: 13024 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (17)..(17): base is a locked nucleic acid
ggytttataargtaarr

SEQ ID NO: 13025 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (11)..(11): base is a locked nucleic acid
ggytttataargtaarr

SEQ ID NO: 13026 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (10)..(10): base is a locked nucleic acid
ggytttataargtaarr

SEQ ID NO: 13027 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
aggytttayaargtaar

SEQ ID NO: 13028 - DNA, 17 bp, Artificial Sequence
  Oligonucleotide probe
  misc_binding (1)..(17): Hybridization probe for the specific detection of mutant HIV-1 at codon 54 of the protease gene.
  modified_base (6)..(6): base is a locked nucleic acid
aggytttayaargtaar

SEQ ID NO: 13029 - DNA, 17 bp, Artificial Sequence
  Oligonucleotide probe
  misc_binding (1)..(17): Hybridization probe for the specific detection of mutant HIV-1 at codon 54 of the protease gene.
  modified_base (2)..(2): base is a locked nucleic acid
aggytttayaargtaar

SEQ ID NO: 13030 - DNA, 17 bp, Artificial Sequence
  Oligonucleotide probe
  misc_binding (1)..(17): Hybridization probe for the specific detection of mutant HIV-1 at codon 54 of the protease gene.
  modified_base (7)..(7): base is a locked nucleic acid
aggytttayaargtaar

SEQ ID NO: 13031 - DNA, 17 bp, Artificial Sequence
  Oligonucleotide probe
  misc_binding (1)..(17): Hybridization probe for the specific detection of mutant HIV-1 at codon 54 of the protease gene.
  modified_base (3)..(3): base is a locked nucleic acid
aggytttayaargtaar

SEQ ID NO: 13032 - DNA, 17 bp, Artificial Sequence
  Oligonucleotide probe
  misc_binding (1)..(17): Hybridization probe for the specific detection of mutant HIV-1 at codon 54 of the protease gene.
  modified_base (9)..(9): base is a locked nucleic acid
aggytttayaargtaar

SEQ ID NO: 13033 - DNA, 17 bp, Artificial Sequence
  Oligonucleotide probe
  misc_binding (1)..(17): Hybridization probe for the specific detection of mutant HIV-1 at codon 54 of the protease gene.
  modified_base (12)..(12): base is a locked nucleic acid
aggytttayaargtaar

SEQ ID NO: 13034 - DNA, 17 bp, Artificial Sequence
  Oligonucleotide probe
  misc_binding (1)..(17): Hybridization probe for the specific detection of mutant HIV-1 at codon 54 of the protease gene.
  modified_base (15)..(15): base is a locked nucleic acid
aggytttayaargtaar

SEQ ID NO: 13035 - DNA, 17 bp, Artificial Sequence
  Oligonucleotide probe
  misc_binding (1)..(17): Hybridization probe for the specific detection of mutant HIV-1 at codon 54 of the protease gene.
  modified_base (10)..(10): base is a locked nucleic acid
aggytttayaargtaar

SEQ ID NO: 13036 - DNA, 17 bp, Artificial Sequence
  Oligonucleotide probe
  misc_binding (1)..(17): Hybridization probe for the specific detection of mutant HIV-1 at codon 54 of the protease gene.
  modified_base (6)..(6): base is a locked nucleic acid
  modified_base (8)..(8): base is a locked nucleic acid
  modified_base (9)..(9): base is a locked nucleic acid
aggytttayaargtaar

SEQ ID NO: 13037 - DNA, 17 bp, Artificial Sequence
  Oligonucleotide probe
  misc_binding (1)..(17): Hybridization probe for the specific detection of mutant HIV-1 at codon 54 of the protease gene.
  modified_base (3)..(3): base is a locked nucleic acid
  modified_base (8)..(8): base is a locked nucleic acid
  modified_base (9)..(9): base is a locked nucleic acid
aggytttayaargtaar

SEQ ID NO: 13038 - DNA, 17 bp, Artificial Sequence
  Oligonucleotide probe
  misc_binding (1)..(17): Hybridization probe for the specific detection of mutant HIV-1 at codon 54 of the protease gene.
  modified_base (2)..(2): base is a locked nucleic acid
  modified_base (8)..(8): base is a locked nucleic acid
  modified_base (9)..(9): base is a locked nucleic acid
aggytttayaargtaar

SEQ ID NO: 13039 - DNA, 17 bp, Artificial Sequence
  Oligonucleotide probe
  misc_binding (1)..(17): Hybridization probe for the specific detection of mutant HIV-1 at codon 54 of the protease gene.
  modified_base (4)..(4): base is a locked nucleic acid
  modified_base (8)..(8): base is a locked nucleic acid
  modified_base (9)..(9): base is a locked nucleic acid
aggytttayaargtaar

SEQ ID NO: 13040 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (15)..(15): base is a locked nucleic acid
aggytttayaargtaar

SEQ ID NO: 13041 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (14)..(14): base is a locked nucleic acid
aggytttayaargtaar

SEQ ID NO: 13042 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (12)..(12): base is a locked nucleic acid
aggytttayaargtaar

SEQ ID NO: 13043 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (10)..(10): base is a locked nucleic acid
aggytttayaargtaar

SEQ ID NO: 13044 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
gaggyttttyaargtaa

SEQ ID NO: 13045 - DNA, 17 bp, Artificial Sequence
  Oligonucleotide probe
  misc_binding (1)..(17): Hybridization probe for the specific detection of mutant HIV-1 at codon 54 of the protease gene.
  modified_base (3)..(3): base is a locked nucleic acid
gaggyttttyaargtaa

SEQ ID NO: 13046 - DNA, 17 bp, Artificial Sequence
  Oligonucleotide probe
  misc_binding (1)..(17): Hybridization probe for the specific detection of mutant HIV-1 at codon 54 of the protease gene.
  modified_base (1)..(1): base is a locked nucleic acid
gaggyttttyaargtaa

SEQ ID NO: 13047 - DNA, 17 bp, Artificial Sequence
  Oligonucleotide probe
  misc_binding (1)..(17): Hybridization probe for the specific detection of mutant HIV-1 at codon 54 of the protease gene.
  modified_base (2)..(2): base is a locked nucleic acid
gaggyttttyaargtaa

SEQ ID NO: 13048 - DNA, 17 bp, Artificial Sequence
  Oligonucleotide probe
  misc_binding (1)..(17): Hybridization probe for the specific detection of mutant HIV-1 at codon 54 of the protease gene.
  modified_base (6)..(6): base is a locked nucleic acid
gaggyttttyaargtaa

SEQ ID NO: 13049 - DNA, 17 bp, Artificial Sequence
  Oligonucleotide probe
  misc_binding (1)..(17): Hybridization probe for the specific detection of mutant HIV-1 at codon 54 of the protease gene.
  modified_base (11)..(11): base is a locked nucleic acid
gaggyttttyaargtaa

SEQ ID NO: 13050 - DNA, 17 bp, Artificial Sequence
  Oligonucleotide probe
  misc_binding (1)..(17): Hybridization probe for the specific detection of mutant HIV-1 at codon 54 of the protease gene.
  modified_base (16)..(16): base is a locked nucleic acid
gaggyttttyaargtaa

SEQ ID NO: 13051 - DNA, 17 bp, Artificial Sequence
  Oligonucleotide probe
  misc_binding (1)..(17): Hybridization probe for the specific detection of mutant HIV-1 at codon 54 of the protease gene.
  modified_base (15)..(15): base is a locked nucleic acid
gaggyttttyaargtaa

SEQ ID NO: 13052 - DNA, 17 bp, Artificial Sequence
  Oligonucleotide probe
  misc_binding (1)..(17): Hybridization probe for the specific detection of mutant HIV-1 at codon 54 of the protease gene.
  modified_base (17)..(17): base is a locked nucleic acid
gaggyttttyaargtaa

SEQ ID NO: 13053 - DNA, 17 bp, Artificial Sequence
  Oligonucleotide probe
  misc_binding (1)..(17): Hybridization probe for the specific detection of mutant HIV-1 at codon 54 of the protease gene.
  modified_base (2)..(2): base is a locked nucleic acid
  modified_base (8)..(8): base is a locked nucleic acid
  modified_base (9)..(9): base is a locked nucleic acid
gaggyttttyaargtaa

SEQ ID NO: 13054 - DNA, 17 bp, Artificial Sequence
  Oligonucleotide probe
  misc_binding (1)..(17): Hybridization probe for the specific detection of mutant HIV-1 at codon 54 of the protease gene.
  modified_base (1)..(1): base is a locked nucleic acid
  modified_base (8)..(8): base is a locked nucleic acid
  modified_base (9)..(9): base is a locked nucleic acid
gaggyttttyaargtaa

SEQ ID NO: 13055 - DNA, 17 bp, Artificial Sequence
  Oligonucleotide probe
  misc_binding (1)..(17): Hybridization probe for the specific detection of mutant HIV-1 at codon 54 of the protease gene.
  modified_base (6)..(6): base is a locked nucleic acid
  modified_base (8)..(8): base is a locked nucleic acid
  modified_base (9)..(9): base is a locked nucleic acid
gaggyttttyaargtaa

SEQ ID NO: 13056 - DNA, 17 bp, Artificial Sequence
  Oligonucleotide probe
  misc_binding (1)..(17): Hybridization probe for the specific detection of mutant HIV-1 at codon 54 of the protease gene.
  modified_base (3)..(3): base is a locked nucleic acid
  modified_base (8)..(8): base is a locked nucleic acid
  modified_base (9)..(9): base is a locked nucleic acid
gaggyttttyaargtaa

SEQ ID NO: 13057 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (13)..(13): base is a locked nucleic acid
gaggyttttyaargtaa

SEQ ID NO: 13058 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (12)..(12): base is a locked nucleic acid
gaggyttttyaargtaa

SEQ ID NO: 13059 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (14)..(14): base is a locked nucleic acid
gaggyttttyaargtaa

SEQ ID NO: 13060 - DNA, 17 bp, Artificial Sequence
  Oligonucleotide probe
  misc_binding (1)..(17): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (11)..(11): base is a locked nucleic acid
gaggyttttyaargtaa

SEQ ID NO: 13061 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
ggytttataargtaa

SEQ ID NO: 13062 - DNA, 15 bp, Artificial Sequence
  Oligonucleotide probe
  misc_binding (1)..(15): Hybridization probe for the specific detection of mutant HIV-1 at codon 54 of the protease gene.
  modified_base (5)..(5): base is a locked nucleic acid
ggytttataargtaa

SEQ ID NO: 13063 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
ggytttataargtaa

SEQ ID NO: 13064 - DNA, 15 bp, Artificial Sequence
  Oligonucleotide probe
  misc_binding (1)..(15): Hybridization probe for the specific detection of mutant HIV-1 at codon 54 of the protease gene.
  modified_base (6)..(6): base is a locked nucleic acid
ggytttataargtaa

SEQ ID NO: 13065 - DNA, 15 bp, Artificial Sequence
  Oligonucleotide probe
  misc_binding (1)..(15): Hybridization probe for the specific detection of mutant HIV-1 at codon 54 of the protease gene.
  modified_base (7)..(7): base is a locked nucleic acid
ggytttataargtaa

SEQ ID NO: 13066 - DNA, 15 bp, Artificial Sequence
  Oligonucleotide probe
  misc_binding (1)..(15): Hybridization probe for the specific detection of mutant HIV-1 at codon 54 of the protease gene.
  modified_base (9)..(9): base is a locked nucleic acid
ggytttataargtaa

SEQ ID NO: 13067 - DNA, 15 bp, Artificial Sequence
  Oligonucleotide probe
  misc_binding (1)..(15): Hybridization probe for the specific detection of mutant HIV-1 at codon 54 of the protease gene.
  modified_base (13)..(13): base is a locked nucleic acid
ggytttataargtaa

SEQ ID NO: 13068 - DNA, 15 bp, Artificial Sequence
  Oligonucleotide probe
  misc_binding (1)..(15): Hybridization probe for the specific detection of mutant HIV-1 at codon 54 of the protease gene.
  modified_base (15)..(15): base is a locked nucleic acid
ggytttataargtaa

SEQ ID NO: 13069 - DNA, 15 bp, Artificial Sequence
  Oligonucleotide probe
  misc_binding (1)..(15): Hybridization probe for the specific detection of mutant HIV-1 at codon 54 of the protease gene.
  modified_base (11)..(11): base is a locked nucleic acid
ggytttataargtaa

SEQ ID NO: 13070 - DNA, 15 bp, Artificial Sequence
  Oligonucleotide probe
  misc_binding (1)..(15): Hybridization probe for the specific detection of mutant HIV-1 at codon 54 of the protease gene.
  modified_base (5)..(5): base is a locked nucleic acid
  modified_base (8)..(8): base is a locked nucleic acid
  modified_base (9)..(9): base is a locked nucleic acid
ggytttataargtaa

SEQ ID NO: 13071 - DNA, 15 bp, Artificial Sequence
  Oligonucleotide probe
  misc_binding (1)..(15): Hybridization probe for the specific detection of mutant HIV-1 at codon 54 of the protease gene.
  modified_base (4)..(4): base is a locked nucleic acid
  modified_base (8)..(8): base is a locked nucleic acid
  modified_base (9)..(9): base is a locked nucleic acid
ggytttataargtaa

SEQ ID NO: 13072 - DNA, 15 bp, Artificial Sequence
  Oligonucleotide probe
  misc_binding (1)..(15): Hybridization probe for the specific detection of mutant HIV-1 at codon 54 of the protease gene.
  modified_base (3)..(3): base is a locked nucleic acid
  modified_base (8)..(8): base is a locked nucleic acid
  modified_base (9)..(9): base is a locked nucleic acid
ggytttataargtaa

SEQ ID NO: 13073 - DNA, 15 bp, Artificial Sequence
  Oligonucleotide probe
  misc_binding (1)..(15): Hybridization probe for the specific detection of mutant HIV-1 at codon 54 of the protease gene.
  modified_base (2)..(2): base is a locked nucleic acid
  modified_base (8)..(8): base is a locked nucleic acid
  modified_base (9)..(9): base is a locked nucleic acid
ggytttataargtaa

SEQ ID NO: 13074 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (12)..(12): base is a locked nucleic acid
ggytttataargtaa

SEQ ID NO: 13075 - DNA, 16 bp, Artificial Sequence
  Oligonucleotide probe
  misc_binding (1)..(16): Hybridization probe for the specific detection of mutant HIV-1 at codon 54 of the protease gene.
  modified_base (8)..(8): base is a locked nucleic acid
  modified_base (9)..(9): base is a locked nucleic acid
ggytttataargtaar

SEQ ID NO: 13076 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (11)..(11): base is a locked nucleic acid
ggytttataargtaa

SEQ ID NO: 13077 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (10)..(10): base is a locked nucleic acid
ggytttataargtaa

SEQ ID NO: 13078 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
aggytttayaargta

SEQ ID NO: 13079 - DNA, 15 bp, Artificial Sequence
  Oligonucleotide probe
  misc_binding (1)..(15): Hybridization probe for the specific detection of mutant HIV-1 at codon 54 of the protease gene.
  modified_base (6)..(6): base is a locked nucleic acid
aggytttayaargta

SEQ ID NO: 13080 - DNA, 15 bp, Artificial Sequence
  Oligonucleotide probe
  misc_binding (1)..(15): Hybridization probe for the specific detection of mutant HIV-1 at codon 54 of the protease gene.
  modified_base (2)..(2): base is a locked nucleic acid
aggytttayaargta

SEQ ID NO: 13081 - DNA, 15 bp, Artificial Sequence
  Oligonucleotide probe
  misc_binding (1)..(15): Hybridization probe for the specific detection of mutant HIV-1 at codon 54 of the protease gene.
  modified_base (7)..(7): base is a locked nucleic acid
aggytttayaargta

SEQ ID NO: 13082 - DNA, 15 bp, Artificial Sequence
  Oligonucleotide probe
  misc_binding (1)..(15): Hybridization probe for the specific detection of mutant HIV-1 at codon 54 of the protease gene.
  modified_base (3)..(3): base is a locked nucleic acid
aggytttayaargta

SEQ ID NO: 13083 - DNA, 15 bp, Artificial Sequence
  Oligonucleotide probe
  misc_binding (1)..(15): Hybridization probe for the specific detection of mutant HIV-1 at codon 54 of the protease gene.
  modified_base (9)..(9): base is a locked nucleic acid
aggytttayaargta

SEQ ID NO: 13084 - DNA, 15 bp, Artificial Sequence
  Oligonucleotide probe
  misc_binding (1)..(15): Hybridization probe for the specific detection of mutant HIV-1 at codon 54 of the protease gene.
  modified_base (12)..(12): base is a locked nucleic acid
aggytttayaargta

SEQ ID NO: 13085 - DNA, 15 bp, Artificial Sequence
  Oligonucleotide probe
  misc_binding (1)..(15): Hybridization probe for the specific detection of mutant HIV-1 at codon 54 of the protease gene.
  modified_base (15)..(15): base is a locked nucleic acid
aggytttayaargta

SEQ ID NO: 13086 - DNA, 15 bp, Artificial Sequence
  Oligonucleotide probe
  misc_binding (1)..(15): Hybridization probe for the specific detection of mutant HIV-1 at codon 54 of the protease gene.
  modified_base (10)..(10): base is a locked nucleic acid
aggytttayaargta

SEQ ID NO: 13087 - DNA, 15 bp, Artificial Sequence
  Oligonucleotide probe
  misc_binding (1)..(15): Hybridization probe for the specific detection of mutant HIV-1 at codon 54 of the protease gene.
  modified_base (6)..(6): base is a locked nucleic acid
  modified_base (8)..(8): base is a locked nucleic acid
  modified_base (9)..(9): base is a locked nucleic acid
aggytttayaargta

SEQ ID NO: 13088 - DNA, 15 bp, Artificial Sequence
  Oligonucleotide probe
  misc_binding (1)..(15): Hybridization probe for the specific detection of mutant HIV-1 at codon 54 of the protease gene.
  modified_base (3)..(3): base is a locked nucleic acid
  modified_base (8)..(8): base is a locked nucleic acid
  modified_base (9)..(9): base is a locked nucleic acid
aggytttayaargta

SEQ ID NO: 13089 - DNA, 15 bp, Artificial Sequence
  Oligonucleotide probe
  misc_binding (1)..(15): Hybridization probe for the specific detection of mutant HIV-1 at codon 54 of the protease gene.
  modified_base (2)..(2): base is a locked nucleic acid
  modified_base (8)..(8): base is a locked nucleic acid
  modified_base (9)..(9): base is a locked nucleic acid
aggytttayaargta

SEQ ID NO: 13090 - DNA, 15 bp, Artificial Sequence
  Oligonucleotide probe
  misc_binding (1)..(15): Hybridization probe for the specific detection of mutant HIV-1 at codon 54 of the protease gene.
  modified_base (4)..(4): base is a locked nucleic acid
  modified_base (8)..(8): base is a locked nucleic acid
  modified_base (9)..(9): base is a locked nucleic acid
aggytttayaargta

SEQ ID NO: 13091 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (15)..(15): base is a locked nucleic acid
aggytttayaargta

SEQ ID NO: 13092 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (14)..(14): base is a locked nucleic acid
aggytttayaargta

SEQ ID NO: 13093 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (12)..(12): base is a locked nucleic acid
aggytttayaargta

SEQ ID NO: 13094 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (10)..(10): base is a locked nucleic acid
aggytttayaargta

SEQ ID NO: 13095 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
gaggyttttyaargt

SEQ ID NO: 13096 - DNA, 15 bp, Artificial Sequence
  Oligonucleotide probe
  misc_binding (1)..(15): Hybridization probe for the specific detection of mutant HIV-1 at codon 54 of the protease gene.
  modified_base (3)..(3): base is a locked nucleic acid
gaggyttttyaargt

SEQ ID NO: 13097 - DNA, 15 bp, Artificial Sequence
  Oligonucleotide probe
  misc_binding (1)..(15): Hybridization probe for the specific detection of mutant HIV-1 at codon 54 of the protease gene.
  modified_base (1)..(1): base is a locked nucleic acid
gaggyttttyaargt

SEQ ID NO: 13098 - DNA, 15 bp, Artificial Sequence
  Oligonucleotide probe
  misc_binding (1)..(15): Hybridization probe for the specific detection of mutant HIV-1 at codon 54 of the protease gene.
  modified_base (2)..(2): base is a locked nucleic acid
gaggyttttyaargt

SEQ ID NO: 13099 - DNA, 15 bp, Artificial Sequence
  Oligonucleotide probe
  misc_binding (1)..(15): Hybridization probe for the specific detection of mutant HIV-1 at codon 54 of the protease gene.
  modified_base (6)..(6): base is a locked nucleic acid
gaggyttttyaargt

SEQ ID NO: 13100 - DNA, 15 bp, Artificial Sequence
  Oligonucleotide probe
  misc_binding (1)..(15): Hybridization probe for the specific detection of mutant HIV-1 at codon 54 of the protease gene.
  modified_base (11)..(11): base is a locked nucleic acid
gaggyttttyaargt

SEQ ID NO: 13101 - DNA, 15 bp, Artificial Sequence
  Oligonucleotide probe
  misc_binding (1)..(15): Hybridization probe for the specific detection of mutant HIV-1 at codon 54 of the protease gene.
gaggyttttyaargt

SEQ ID NO: 13102 - DNA, 15 bp, Artificial Sequence
  Oligonucleotide probe
  misc_binding (1)..(15): Hybridization probe for the specific detection of mutant HIV-1 at codon 54 of the protease gene.
  modified_base (15)..(15): base is a locked nucleic acid
gaggyttttyaargt

SEQ ID NO: 13103 - DNA, 16 bp, Artificial Sequence
  Oligonucleotide probe
  misc_binding (1)..(16): Hybridization probe for the specific detection of mutant HIV-1 at codon 54 of the protease gene.
gaggyttttyaargta

SEQ ID NO: 13104 - DNA, 15 bp, Artificial Sequence
  Oligonucleotide probe
  misc_binding (1)..(15): Hybridization probe for the specific detection of mutant HIV-1 at codon 54 of the protease gene.
  modified_base (2)..(2): base is a locked nucleic acid
  modified_base (8)..(8): base is a locked nucleic acid
  modified_base (9)..(9): base is a locked nucleic acid
gaggyttttyaargt

SEQ ID NO: 13105 - DNA, 15 bp, Artificial Sequence
  Oligonucleotide probe
  misc_binding (1)..(15): Hybridization probe for the specific detection of mutant HIV-1 at codon 54 of the protease gene.
  modified_base (1)..(1): base is a locked nucleic acid
  modified_base (8)..(8): base is a locked nucleic acid
  modified_base (9)..(9): base is a locked nucleic acid
gaggyttttyaargt

SEQ ID NO: 13106 - DNA, 15 bp, Artificial Sequence
  Oligonucleotide probe
  misc_binding (1)..(15): Hybridization probe for the specific detection of mutant HIV-1 at codon 54 of the protease gene.
  modified_base (6)..(6): base is a locked nucleic acid
  modified_base (8)..(8): base is a locked nucleic acid
  modified_base (9)..(9): base is a locked nucleic acid
gaggyttttyaargt

SEQ ID NO: 13107 - DNA, 15 bp, Artificial Sequence
  Oligonucleotide probe
  misc_binding (1)..(15): Hybridization probe for the specific detection of mutant HIV-1 at codon 54 of the protease gene.
  modified_base (3)..(3): base is a locked nucleic acid
  modified_base (8)..(8): base is a locked nucleic acid
  modified_base (9)..(9): base is a locked nucleic acid
gaggyttttyaargt

SEQ ID NO: 13108 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (13)..(13): base is a locked nucleic acid
gaggyttttyaargt

SEQ ID NO: 13109 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (12)..(12): base is a locked nucleic acid
gaggyttttyaargt

SEQ ID NO: 13110 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (14)..(14): base is a locked nucleic acid
gaggyttttyaargt

SEQ ID NO: 13111 - DNA, 15 bp, Artificial Sequence
  Oligonucleotide probe
  misc_binding (1)..(15): Hybridization probe for the specific detection of mutant HIV-1 at codon 54 of the protease gene.
  modified_base (8)..(8): base is a locked nucleic acid
  modified_base (9)..(9): base is a locked nucleic acid
  modified_base (11)..(11): base is a locked nucleic acid
gaggyttttyaargt

SEQ ID NO: 13112 - DNA, 15 bp, Artificial Sequence
  Oligonucleotide probe
  misc_binding (1)..(15): Hybridization probe for the specific detection of mutant HIV-1 at codon 54 of the protease gene.
tactttracaaaacc

SEQ ID NO: 13113 - DNA, 15 bp, Artificial Sequence
  Oligonucleotide probe
  misc_binding (1)..(15): Hybridization probe for the specific detection of mutant HIV-1 at codon 54 of the protease gene.
tactttrgtaaaacc

SEQ ID NO: 13114 - DNA, 15 bp, Artificial Sequence
  Oligonucleotide probe
  misc_binding (1)..(15): Hybridization probe for the specific detection of mutant HIV-1 at codon 54 of the protease gene.
tactttrgcaaaacc

SEQ ID NO: 13115 - DNA, 15 bp, Artificial Sequence
  Oligonucleotide probe
  misc_binding (1)..(15): Hybridization probe for the specific detection of mutant HIV-1 at codon 54 of the protease gene.
tactttragaaaacc

SEQ ID NO: 13116 - DNA, 15 bp, Artificial Sequence
  Oligonucleotide probe
  misc_binding (1)..(15): Hybridization probe for the specific detection of mutant HIV-1 at codon 54 of the protease gene.
tactttrctaaaacc

SEQ ID NO: 13117 - DNA, 15 bp, Artificial Sequence
  Oligonucleotide probe
  misc_binding (1)..(15): Hybridization probe for the specific detection of mutant HIV-1 at codon 54 of the protease gene.
tactttcataaaacc

SEQ ID NO: 13118 - DNA, 19 bp, Artificial Sequence
  Oligonucleotide probe
  misc_binding (1)..(19): Hybridization probe for the specific detection of mutant HIV-1 at codon 54 of the protease gene.
aggytttataargtaarrc

SEQ ID NO: 13119 - DNA, 19 bp, Artificial Sequence
  Oligonucleotide probe
  misc_binding (1)..(19): Hybridization probe for the specific detection of mutant HIV-1 at codon 54 of the protease gene.
gaggytttayaargtaarr

SEQ ID NO: 13120 - DNA, 19 bp, Artificial Sequence
  Oligonucleotide probe
  misc_binding (1)..(19): Hybridization probe for the specific detection of mutant HIV-1 at codon 54 of the protease gene.
ggaggyttttyaargtaar

SEQ ID NO: 13121 - DNA, 18 bp, Artificial Sequence
  Oligonucleotide probe
  misc_binding (1)..(18): Hybridization probe for the specific detection of mutant HIV-1 at codon 54 of the protease gene.
aggytttataargtaarr

SEQ ID NO: 13122 - DNA, 18 bp, Artificial Sequence
  Oligonucleotide probe
  misc_binding (1)..(18): Hybridization probe for the specific detection of mutant HIV-1 at codon 54 of the protease gene.
gaggytttayaargtaar

SEQ ID NO: 13123 - DNA, 18 bp, Artificial Sequence
  Oligonucleotide probe
  misc_binding (1)..(18): Hybridization probe for the specific detection of mutant HIV-1 at codon 54 of the protease gene.
ggaggyttttyaargtaa

SEQ ID NO: 13124 - DNA, 17 bp, Artificial Sequence
  Oligonucleotide probe
  misc_binding (1)..(17): Hybridization probe for the specific detection of mutant HIV-1 at codon 54 of the protease gene.
ggytttataargtaarr

SEQ ID NO: 13125 - DNA, 17 bp, Artificial Sequence
  Oligonucleotide probe
  misc_binding (1)..(17): Hybridization probe for the specific detection of mutant HIV-1 at codon 54 of the protease gene.
aggytttayaargtaar

SEQ ID NO: 13126 - DNA, 17 bp, Artificial Sequence
  Oligonucleotide probe
  misc_binding (1)..(17): Hybridization probe for the specific detection of mutant HIV-1 at codon 54 of the protease gene.
gaggyttttyaargtaa

SEQ ID NO: 13127 - DNA, 15 bp, Artificial Sequence
  Oligonucleotide probe
  misc_binding (1)..(15): Hybridization probe for the specific detection of mutant HIV-1 at codon 54 of the protease gene.
ggytttataargtaa

SEQ ID NO: 13128 - DNA, 16 bp, Artificial Sequence
  Oligonucleotide probe
  misc_binding (1)..(16): Hybridization probe for the specific detection of mutant HIV-1 at codon 54 of the protease gene.
ggytttataargtaar

SEQ ID NO: 13129 - DNA, 15 bp, Artificial Sequence
  Oligonucleotide probe
  misc_binding (1)..(15): Hybridization probe for the specific detection of mutant HIV-1 at codon 54 of the protease gene.
aggytttayaargta

SEQ ID NO: 13130 - DNA, 15 bp, Artificial Sequence
  Oligonucleotide probe
  misc_binding (1)..(15): Hybridization probe for the specific detection of mutant HIV-1 at codon 54 of the protease gene.
gaggyttttyaargt

SEQ ID NO: 13131 - DNA, 19 bp, Artificial Sequence
  Oligonucleotide probe
  misc_binding (1)..(19): Hybridization probe for the specific detection of mutant HIV-1 at codon 58 of the protease gene.
  modified_base (9)..(9): base is a locked nucleic acid
  modified_base (10)..(10): base is a locked nucleic acid
aargtaarrartatgaksa

SEQ ID NO: 13132 - DNA, 19 bp, Artificial Sequence
  Oligonucleotide probe
  misc_binding (1)..(19): Hybridization probe for the specific detection of mutant HIV-1 at codon 58 of the protease gene.
  modified_base (3)..(3): base is a locked nucleic acid
aargtaarrartatgaksa

SEQ ID NO: 13133 - DNA, 19 bp, Artificial Sequence
  Oligonucleotide probe
  misc_binding (1)..(19): Hybridization probe for the specific detection of mutant HIV-1 at codon 58 of the protease gene.
  modified_base (8)..(8): base is a locked nucleic acid
aargtaarrartatgaksa

SEQ ID NO: 13134 - DNA, 19 bp, Artificial Sequence
  Oligonucleotide probe
  misc_binding (1)..(19): Hybridization probe for the specific detection of mutant HIV-1 at codon 58 of the protease gene.
  modified_base (2)..(2): base is a locked nucleic acid
aargtaarrartatgaksa

SEQ ID NO: 13135 - DNA, 19 bp, Artificial Sequence
  Oligonucleotide probe
  misc_binding (1)..(19): Hybridization probe for the specific detection of mutant HIV-1 at codon 58 of the protease gene.
  modified_base (9)..(9): base is a locked nucleic acid
aargtaarrartatgaksa

SEQ ID NO: 13136 - DNA, 19 bp, Artificial Sequence
  Oligonucleotide probe
  misc_binding (1)..(19): Hybridization probe for the specific detection of mutant HIV-1 at codon 58 of the protease gene.
  modified_base (13)..(13): base is a locked nucleic acid
aargtaarrartatgaksa

SEQ ID NO: 13137 - DNA, 19 bp, Artificial Sequence
  Oligonucleotide probe
  misc_binding (1)..(19): Hybridization probe for the specific detection of mutant HIV-1 at codon 58 of the protease gene.
  modified_base (18)..(18): base is a locked nucleic acid
aargtaarrartatgaksa

SEQ ID NO: 13138 - DNA, 19 bp, Artificial Sequence
  Oligonucleotide probe
  misc_binding (1)..(19): Hybridization probe for the specific detection of mutant HIV-1 at codon 58 of the protease gene.
  modified_base (11)..(11): base is a locked nucleic acid
aargtaarrartatgaksa

SEQ ID NO: 13139 - DNA, 19 bp, Artificial Sequence
  Oligonucleotide probe
  misc_binding (1)..(19): Hybridization probe for the specific detection of mutant HIV-1 at codon 58 of the protease gene.
  modified_base (12)..(12): base is a locked nucleic acid
aargtaarrartatgaksa

SEQ ID NO: 13140 - DNA, 19 bp, Artificial Sequence
  Oligonucleotide probe
  misc_binding (1)..(19): Hybridization probe for the specific detection of mutant HIV-1 at codon 58 of the protease gene.
  modified_base (3)..(3): base is a locked nucleic acid
  modified_base (9)..(9): base is a locked nucleic acid
  modified_base (10)..(10): base is a locked nucleic acid
aargtaarrartatgaksa

SEQ ID NO: 13141 - DNA, 19 bp, Artificial Sequence
  Oligonucleotide probe
  misc_binding (1)..(19): Hybridization probe for the specific detection of mutant HIV-1 at codon 58 of the protease gene.
  modified_base (5)..(5): base is a locked nucleic acid
  modified_base (9)..(9): base is a locked nucleic acid
  modified_base (10)..(10): base is a locked nucleic acid
aargtaarrartatgaksa

SEQ ID NO: 13142 - DNA, 19 bp, Artificial Sequence
  Oligonucleotide probe
  misc_binding (1)..(19): Hybridization probe for the specific detection of mutant HIV-1 at codon 58 of the protease gene.
  modified_base (4)..(4): base is a locked nucleic acid
  modified_base (9)..(9): base is a locked nucleic acid
  modified_base (10)..(10): base is a locked nucleic acid
aargtaarrartatgaksa

SEQ ID NO: 13143 - DNA, 19 bp, Artificial Sequence
  Oligonucleotide probe
  misc_binding (1)..(19): Hybridization probe for the specific detection of mutant HIV-1 at codon 58 of the protease gene.
  modified_base (2)..(2): base is a locked nucleic acid
  modified_base (9)..(9): base is a locked nucleic acid
  modified_base (10)..(10): base is a locked nucleic acid
aargtaarrartatgaksa

SEQ ID NO: 13144 - DNA, 19 bp, Artificial Sequence
  Oligonucleotide probe
  misc_binding (1)..(19): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (18)..(18): base is a locked nucleic acid
aargtaarrartatgaksa

SEQ ID NO: 13145 - DNA, 19 bp, Artificial Sequence
  Oligonucleotide probe
  misc_binding (1)..(19): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (15)..(15): base is a locked nucleic acid
aargtaarrartatgaksa

SEQ ID NO: 13146 - DNA, 19 bp, Artificial Sequence
  Oligonucleotide probe
  misc_binding (1)..(19): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (14)..(14): base is a locked nucleic acid
aargtaarrartatgaksa

SEQ ID NO: 13147 - DNA, 19 bp, Artificial Sequence
  Oligonucleotide probe
  misc_binding (1)..(19): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (12)..(12): base is a locked nucleic acid
aargtaarrartatgaksa

SEQ ID NO: 13148 - DNA, 18 bp, Artificial Sequence
  Oligonucleotide probe
  misc_binding (1)..(18): Hybridization probe for the specific detection of mutant HIV-1 at codon 58 of the protease gene.
  modified_base (9)..(9): base is a locked nucleic acid
  modified_base (10)..(10): base is a locked nucleic acid
aargtaarrartatgaks

SEQ ID NO: 13149 - DNA, 18 bp, Artificial Sequence
  Oligonucleotide probe
  misc_binding (1)..(18): Hybridization probe for the specific detection of mutant HIV-1 at codon 58 of the protease gene.
  modified_base (3)..(3): base is a locked nucleic acid
aargtaarrartatgaks

SEQ ID NO: 13150 - DNA, 18 bp, Artificial Sequence
  Oligonucleotide probe
  misc_binding (1)..(18): Hybridization probe for the specific detection of mutant HIV-1 at codon 58 of the protease gene.
  modified_base (8)..(8): base is a locked nucleic acid
aargtaarrartatgaks

SEQ ID NO: 13151 - DNA, 18 bp, Artificial Sequence
  Oligonucleotide probe
  misc_binding (1)..(18): Hybridization probe for the specific detection of mutant HIV-1 at codon 58 of the protease gene.
  modified_base (2)..(2): base is a locked nucleic acid
aargtaarrartatgaks

SEQ ID NO: 13152 - DNA, 18 bp, Artificial Sequence
  Oligonucleotide probe
  misc_binding (1)..(18): Hybridization probe for the specific detection of mutant HIV-1 at codon 58 of the protease gene.
  modified_base (9)..(9): base is a locked nucleic acid
aargtaarrartatgaks

SEQ ID NO: 13153 - DNA, 18 bp, Artificial Sequence
  Oligonucleotide probe
  misc_binding (1)..(18): Hybridization probe for the specific detection of mutant HIV-1 at codon 58 of the protease gene.
  modified_base (13)..(13): base is a locked nucleic acid
aargtaarrartatgaks

SEQ ID NO: 13154 - DNA, 18 bp, Artificial Sequence
  Oligonucleotide probe
  misc_binding (1)..(18): Hybridization probe for the specific detection of mutant HIV-1 at codon 58 of the protease gene.
  modified_base (18)..(18): base is a locked nucleic acid
aargtaarrartatgaks

SEQ ID NO: 13155 - DNA, 18 bp, Artificial Sequence
  Oligonucleotide probe
  misc_binding (1)..(18): Hybridization probe for the specific detection of mutant HIV-1 at codon 58 of the protease gene.
  modified_base (11)..(11): base is a locked nucleic acid
aargtaarrartatgaks

SEQ ID NO: 13156 - DNA, 18 bp, Artificial Sequence
  Oligonucleotide probe
  misc_binding (1)..(18): Hybridization probe for the specific detection of mutant HIV-1 at codon 58 of the protease gene.
  modified_base (12)..(12): base is a locked nucleic acid
aargtaarrartatgaks

SEQ ID NO: 13157 - DNA, 18 bp, Artificial Sequence
  Oligonucleotide probe
  misc_binding (1)..(18): Hybridization probe for the specific detection of mutant HIV-1 at codon 58 of the protease gene.
  modified_base (3)..(3): base is a locked nucleic acid
  modified_base (9)..(9): base is a locked nucleic acid
  modified_base (10)..(10): base is a locked nucleic acid
aargtaarrartatgaks

SEQ ID NO: 13158 - DNA, 18 bp, Artificial Sequence
  Oligonucleotide probe
  misc_binding (1)..(18): Hybridization probe for the specific detection of mutant HIV-1 at codon 58 of the protease gene.
  modified_base (5)..(5): base is a locked nucleic acid
  modified_base (9)..(9): base is a locked nucleic acid
  modified_base (10)..(10): base is a locked nucleic acid
aargtaarrartatgaks

SEQ ID NO: 13159 - DNA, 18 bp, Artificial Sequence
  Oligonucleotide probe
  misc_binding (1)..(18): Hybridization probe for the specific detection of mutant HIV-1 at codon 58 of the protease gene.
  modified_base (4)..(4): base is a locked nucleic acid
  modified_base (9)..(9): base is a locked nucleic acid
  modified_base (10)..(10): base is a locked nucleic acid
aargtaarrartatgaks

SEQ ID NO: 13160 - DNA, 18 bp, Artificial Sequence
  Oligonucleotide probe
  misc_binding (1)..(18): Hybridization probe for the specific detection of mutant HIV-1 at codon 58 of the protease gene.
  modified_base (2)..(2): base is a locked nucleic acid
  modified_base (9)..(9): base is a locked nucleic acid
  modified_base (10)..(10): base is a locked nucleic acid
aargtaarrartatgaks

SEQ ID NO: 13161 - DNA, 18 bp, Artificial Sequence
  Oligonucleotide probe
  misc_binding (1)..(18): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (18)..(18): base is a locked nucleic acid
aargtaarrartatgaks

SEQ ID NO: 13162 - DNA, 18 bp, Artificial Sequence
  Oligonucleotide probe
  misc_binding (1)..(18): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (15)..(15): base is a locked nucleic acid
aargtaarrartatgaks

SEQ ID NO: 13163 - DNA, 18 bp, Artificial Sequence
  Oligonucleotide probe
  misc_binding (1)..(18): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (14)..(14): base is a locked nucleic acid
aargtaarrartatgaks

SEQ ID NO: 13164 - DNA, 18 bp, Artificial Sequence
  Oligonucleotide probe
  misc_binding (1)..(18): Hybridization probe for the specific detection of mutant HIV-1 at codon 58 of the protease gene.
  modified_base (9)..(9): base is a locked nucleic acid
  modified_base (10)..(10): base is a locked nucleic acid
  modified_base (12)..(12): base is a locked nucleic acid
aargtaarrartatgaks

SEQ ID NO: 13165 - DNA, 17 bp, Artificial Sequence
  Oligonucleotide probe
  misc_binding (1)..(17): Hybridization probe for the specific detection of mutant HIV-1 at codon 58 of the protease gene.
  modified_base (8)..(8): base is a locked nucleic acid
  modified_base (9)..(9): base is a locked nucleic acid
argtaarrartatgaks

SEQ ID NO: 13166 - DNA, 17 bp, Artificial Sequence
  Oligonucleotide probe
  misc_binding (1)..(17): Hybridization probe for the specific detection of mutant HIV-1 at codon 58 of the protease gene.
  modified_base (2)..(2): base is a locked nucleic acid
argtaarrartatgaks

SEQ ID NO: 13167 - DNA, 17 bp, Artificial Sequence
  Oligonucleotide probe
  misc_binding (1)..(17): Hybridization probe for the specific detection of mutant HIV-1 at codon 58 of the protease gene.
  modified_base (7)..(7): base is a locked nucleic acid
argtaarrartatgaks

SEQ ID NO: 13168 - DNA, 17 bp, Artificial Sequence
  Oligonucleotide probe
  misc_binding (1)..(17): Hybridization probe for the specific detection of mutant HIV-1 at codon 58 of the protease gene.
  modified_base (1)..(1): base is a locked nucleic acid
argtaarrartatgaks

SEQ ID NO: 13169 - DNA, 17 bp, Artificial Sequence
  Oligonucleotide probe
  misc_binding (1)..(17): Hybridization probe for the specific detection of mutant HIV-1 at codon 58 of the protease gene.
  modified_base (8)..(8): base is a locked nucleic acid
argtaarrartatgaks

SEQ ID NO: 13170 - DNA, 17 bp, Artificial Sequence
  Oligonucleotide probe
  misc_binding (1)..(17): Hybridization probe for the specific detection of mutant HIV-1 at codon 58 of the protease gene.
  modified_base (12)..(12): base is a locked nucleic acid
argtaarrartatgaks

SEQ ID NO: 13171 - DNA, 17 bp, Artificial Sequence
  Oligonucleotide probe
  misc_binding (1)..(17): Hybridization probe for the specific detection of mutant HIV-1 at codon 58 of the protease gene.
  modified_base (17)..(17): base is a locked nucleic acid
argtaarrartatgaks

SEQ ID NO: 13172 - DNA, 17 bp, Artificial Sequence
  Oligonucleotide probe
  misc_binding (1)..(17): Hybridization probe for the specific detection of mutant HIV-1 at codon 58 of the protease gene.
  modified_base (10)..(10): base is a locked nucleic acid
argtaarrartatgaks

SEQ ID NO: 13173 - DNA, 17 bp, Artificial Sequence
  Oligonucleotide probe
  misc_binding (1)..(17): Hybridization probe for the specific detection of mutant HIV-1 at codon 58 of the protease gene.
  modified_base (11)..(11): base is a locked nucleic acid
argtaarrartatgaks

SEQ ID NO: 13174 - DNA, 17 bp, Artificial Sequence
  Oligonucleotide probe
  misc_binding (1)..(17): Hybridization probe for the specific detection of mutant HIV-1 at codon 58 of the protease gene.
  modified_base (2)..(2): base is a locked nucleic acid
  modified_base (8)..(8): base is a locked nucleic acid
  modified_base (9)..(9): base is a locked nucleic acid
argtaarrartatgaks

SEQ ID NO: 13175 - DNA, 17 bp, Artificial Sequence
  Oligonucleotide probe
  misc_binding (1)..(17): Hybridization probe for the specific detection of mutant HIV-1 at codon 58 of the protease gene.
  modified_base (4)..(4): base is a locked nucleic acid
  modified_base (8)..(8): base is a locked nucleic acid
  modified_base (9)..(9): base is a locked nucleic acid
argtaarrartatgaks

SEQ ID NO: 13176 - DNA, 17 bp, Artificial Sequence
  Oligonucleotide probe
  misc_binding (1)..(17): Hybridization probe for the specific detection of mutant HIV-1 at codon 58 of the protease gene.
  modified_base (3)..(3): base is a locked nucleic acid
  modified_base (8)..(8): base is a locked nucleic acid
  modified_base (9)..(9): base is a locked nucleic acid
argtaarrartatgaks

SEQ ID NO: 13177 - DNA, 17 bp, Artificial Sequence
  Oligonucleotide probe
  misc_binding (1)..(17): Hybridization probe for the specific detection of mutant HIV-1 at codon 58 of the protease gene.
  modified_base (1)..(1): base is a locked nucleic acid
  modified_base (8)..(8): base is a locked nucleic acid
  modified_base (9)..(9): base is a locked nucleic acid
argtaarrartatgaks

SEQ ID NO: 13178 - DNA, 17 bp, Artificial Sequence
  Oligonucleotide probe
  misc_binding (1)..(17): Hybridization probe for the specific detection of mutant HIV-1 at codon 58 of the protease gene.
  modified_base (8)..(8): base is a locked nucleic acid
  modified_base (9)..(9): base is a locked nucleic acid
  modified_base (17)..(17): base is a locked nucleic acid
argtaarrartatgaks

SEQ ID NO: 13179 - DNA, 17 bp, Artificial Sequence
  Oligonucleotide probe
  misc_binding (1)..(17): Hybridization probe for the specific detection of mutant HIV-1 at codon 58 of the protease gene.
  modified_base (8)..(8): base is a locked nucleic acid
  modified_base (9)..(9): base is a locked nucleic acid
  modified_base (14)..(14): base is a locked nucleic acid
argtaarrartatgaks

SEQ ID NO: 13180 - DNA, 17 bp, Artificial Sequence
  Oligonucleotide probe
  misc_binding (1)..(17): Hybridization probe for the specific detection of mutant HIV-1 at codon 58 of the protease gene.
  modified_base (8)..(8): base is a locked nucleic acid
  modified_base (9)..(9): base is a locked nucleic acid
  modified_base (13)..(13): base is a locked nucleic acid
argtaarrartatgaks

SEQ ID NO: 13181 - DNA, 17 bp, Artificial Sequence
  Oligonucleotide probe
  misc_binding (1)..(17): Hybridization probe for the specific detection of mutant HIV-1 at codon 58 of the protease gene.
  modified_base (8)..(8): base is a locked nucleic acid
  modified_base (9)..(9): base is a locked nucleic acid
  modified_base (11)..(11): base is a locked nucleic acid
argtaarrartatgaks

SEQ ID NO: 13182 - DNA, 15 bp, Artificial Sequence
  Oligonucleotide probe
  misc_binding (1)..(15): Hybridization probe for the specific detection of mutant HIV-1 at codon 58 of the protease gene.
  modified_base (8)..(8): base is a locked nucleic acid
  modified_base (9)..(9): base is a locked nucleic acid
argtaarrartatga

SEQ ID NO: 13183 - DNA, 15 bp, Artificial Sequence
  Oligonucleotide probe
  misc_binding (1)..(15): Hybridization probe for the specific detection of mutant HIV-1 at codon 58 of the protease gene.
  modified_base (2)..(2): base is a locked nucleic acid
argtaarrartatga

SEQ ID NO: 13184 - DNA, 15 bp, Artificial Sequence
  Oligonucleotide probe
  misc_binding (1)..(15): Hybridization probe for the specific detection of mutant HIV-1 at codon 58 of the protease gene.
  modified_base (7)..(7): base is a locked nucleic acid
argtaarrartatga

SEQ ID NO: 13185 - DNA, 15 bp, Artificial Sequence
  Oligonucleotide probe
  misc_binding (1)..(15): Hybridization probe for the specific detection of mutant HIV-1 at codon 58 of the protease gene.
  modified_base (1)..(1): base is a locked nucleic acid
argtaarrartatga

SEQ ID NO: 13186 - DNA, 15 bp, Artificial Sequence
  Oligonucleotide probe
  misc_binding (1)..(15): Hybridization probe for the specific detection of mutant HIV-1 at codon 58 of the protease gene.
  modified_base (8)..(8): base is a locked nucleic acid
argtaarrartatga

SEQ ID NO: 13187 - DNA, 15 bp, Artificial Sequence
  Oligonucleotide probe
  misc_binding (1)..(15): Hybridization probe for the specific detection of mutant HIV-1 at codon 58 of the protease gene.
  modified_base (12)..(12): base is a locked nucleic acid
argtaarrartatga

SEQ ID NO: 13188 - DNA, 16 bp, Artificial Sequence
  Oligonucleotide probe
  misc_binding (1)..(16): Hybridization probe for the specific detection of mutant HIV-1 at codon 58 of the protease gene.
argtaarrartatgak

SEQ ID NO: 13189 - DNA, 15 bp, Artificial Sequence
  Oligonucleotide probe
  misc_binding (1)..(15): Hybridization probe for the specific detection of mutant HIV-1 at codon 58 of the protease gene.
  modified_base (10)..(10): base is a locked nucleic acid
argtaarrartatga

SEQ ID NO: 13190 - DNA, 15 bp, Artificial Sequence
  Oligonucleotide probe
  misc_binding (1)..(15): Hybridization probe for the specific detection of mutant HIV-1 at codon 58 of the protease gene.
  modified_base (11)..(11): base is a locked nucleic acid
argtaarrartatga

SEQ ID NO: 13191 - DNA, 15 bp, Artificial Sequence
  Oligonucleotide probe
  misc_binding (1)..(15): Hybridization probe for the specific detection of mutant HIV-1 at codon 58 of the protease gene.
  modified_base (2)..(2): base is a locked nucleic acid
  modified_base (8)..(8): base is a locked nucleic acid
  modified_base (9)..(9): base is a locked nucleic acid
argtaarrartatga

SEQ ID NO: 13192 - DNA, 15 bp, Artificial Sequence
  Oligonucleotide probe
  misc_binding (1)..(15): Hybridization probe for the specific detection of mutant HIV-1 at codon 58 of the protease gene.
  modified_base (4)..(4): base is a locked nucleic acid
  modified_base (8)..(8): base is a locked nucleic acid
  modified_base (9)..(9): base is a locked nucleic acid
argtaarrartatga

SEQ ID NO: 13193 - DNA, 15 bp, Artificial Sequence
  Oligonucleotide probe
  misc_binding (1)..(15): Hybridization probe for the specific detection of mutant HIV-1 at codon 58 of the protease gene.
  modified_base (3)..(3): base is a locked nucleic acid
  modified_base (8)..(8): base is a locked nucleic acid
  modified_base (9)..(9): base is a locked nucleic acid
argtaarrartatga

SEQ ID NO: 13194 - DNA, 15 bp, Artificial Sequence
  Oligonucleotide probe
  misc_binding (1)..(15): Hybridization probe for the specific detection of mutant HIV-1 at codon 58 of the protease gene.
  modified_base (1)..(1): base is a locked nucleic acid
  modified_base (8)..(8): base is a locked nucleic acid
  modified_base (9)..(9): base is a locked nucleic acid
argtaarrartatga

SEQ ID NO: 13195 - DNA, 16 bp, Artificial Sequence
  Oligonucleotide probe
  misc_binding (1)..(16): Hybridization probe for the specific detection of mutant HIV-1 at codon 58 of the protease gene.
  modified_base (8)..(8): base is a locked nucleic acid
  modified_base (9)..(9): base is a locked nucleic acid
argtaarrartatgak

SEQ ID NO: 13196 - DNA, 15 bp, Artificial Sequence
  Oligonucleotide probe
  misc_binding (1)..(15): Hybridization probe for the specific detection of mutant HIV-1 at codon 58 of the protease gene.
  modified_base (8)..(8): base is a locked nucleic acid
  modified_base (9)..(9): base is a locked nucleic acid
  modified_base (14)..(14): base is a locked nucleic acid
argtaarrartatga

SEQ ID NO: 13197 - DNA, 15 bp, Artificial Sequence
  Oligonucleotide probe
  misc_binding (1)..(15): Hybridization probe for the specific detection of mutant HIV-1 at codon 58 of the protease gene.
  modified_base (8)..(8): base is a locked nucleic acid
  modified_base (9)..(9): base is a locked nucleic acid
  modified_base (13)..(13): base is a locked nucleic acid
argtaarrartatga

SEQ ID NO: 13198 - DNA, 15 bp, Artificial Sequence
  Oligonucleotide probe
  misc_binding (1)..(15): Hybridization probe for the specific detection of mutant HIV-1 at codon 58 of the protease gene.
  modified_base (8)..(8): base is a locked nucleic acid
  modified_base (9)..(9): base is a locked nucleic acid
  modified_base (11)..(11): base is a locked nucleic acid
argtaarrartatga

SEQ ID NO: 13199 - DNA, 15 bp, Artificial Sequence
  Oligonucleotide probe
  misc_binding (1)..(15): Hybridization probe for the specific detection of mutant HIV-1 at codon 58 of the protease gene.
agtaagagartatga

SEQ ID NO: 13200 - DNA, 19 bp, Artificial Sequence
  Oligonucleotide probe
  misc_binding (1)..(19): Hybridization probe for the specific detection of mutant HIV-1 at codon 58 of the protease gene.
aargtaarrartatgaksa

SEQ ID NO: 13201 - DNA, 18 bp, Artificial Sequence
  Oligonucleotide probe
  misc_binding (1)..(18): Hybridization probe for the specific detection of mutant HIV-1 at codon 58 of the protease gene.
aargtaarrartatgaks

SEQ ID NO: 13202 - DNA, 17 bp, Artificial Sequence
  Oligonucleotide probe
  misc_binding (1)..(17): Hybridization probe for the specific detection of mutant HIV-1 at codon 58 of the protease gene.
argtaarrartatgaks

SEQ ID NO: 13203 - DNA, 15 bp, Artificial Sequence
  Oligonucleotide probe
  misc_binding (1)..(15): Hybridization probe for the specific detection of mutant HIV-1 at codon 58 of the protease gene.
argtaarrartatga

SEQ ID NO: 13204 - DNA, 19 bp, Artificial Sequence
  Oligonucleotide probe
  misc_binding (1)..(19): Hybridization probe for the specific detection of mutant HIV-1 at codon 71 of the protease gene.
  modified_base (9)..(9): base is a locked nucleic acid
  modified_base (10)..(10): base is a locked nucleic acid
ggrmawarrcyataggkwc

SEQ ID NO: 13205 - DNA, 19 bp, Artificial Sequence
  Oligonucleotide probe
  misc_binding (1)..(19): Hybridization probe for the specific detection of mutant HIV-1 at codon 71 of the protease gene.
  modified_base (2)..(2): base is a locked nucleic acid
ggrmawarrcyataggkwc

SEQ ID NO: 13206 - DNA, 19 bp, Artificial Sequence
  Oligonucleotide probe
  misc_binding (1)..(19): Hybridization probe for the specific detection of mutant HIV-1 at codon 71 of the protease gene.
  modified_base (7)..(7): base is a locked nucleic acid
ggrmawarrcyataggkwc

SEQ ID NO: 13207 - DNA, 19 bp, Artificial Sequence
  Oligonucleotide probe
  misc_binding (1)..(19): Hybridization probe for the specific detection of mutant HIV-1 at codon 71 of the protease gene.
  modified_base (4)..(4): base is a locked nucleic acid
ggrmawarrcyataggkwc

SEQ ID NO: 13208 - DNA, 19 bp, Artificial Sequence
  Oligonucleotide probe
  misc_binding (1)..(19): Hybridization probe for the specific detection of mutant HIV-1 at codon 71 of the protease gene.
  modified_base (5)..(5): base is a locked nucleic acid
ggrmawarrcyataggkwc

SEQ ID NO: 13209 - DNA, 19 bp, Artificial Sequence
  Oligonucleotide probe
  misc_binding (1)..(19): Hybridization probe for the specific detection of mutant HIV-1 at codon 71 of the protease gene.
  modified_base (15)..(15): base is a locked nucleic acid
ggrmawarrcyataggkwc

SEQ ID NO: 13210 - DNA, 19 bp, Artificial Sequence
  Oligonucleotide probe
  misc_binding (1)..(19): Hybridization probe for the specific detection of mutant HIV-1 at codon 71 of the protease gene.
  modified_base (16)..(16): base is a locked nucleic acid
ggrmawarrcyataggkwc

SEQ ID NO: 13211 - DNA, 19 bp, Artificial Sequence
  Oligonucleotide probe
  misc_binding (1)..(19): Hybridization probe for the specific detection of mutant HIV-1 at codon 71 of the protease gene.
  modified_base (10)..(10): base is a locked nucleic acid
ggrmawarrcyataggkwc

SEQ ID NO: 13212 - DNA, 19 bp, Artificial Sequence
  Oligonucleotide probe
  misc_binding (1)..(19): Hybridization probe for the specific detection of mutant HIV-1 at codon 71 of the protease gene.
  modified_base (11)..(11): base is a locked nucleic acid
ggrmawarrcyataggkwc

SEQ ID NO: 13213 - DNA, 19 bp, Artificial Sequence
  Oligonucleotide probe
  misc_binding (1)..(19): Hybridization probe for the specific detection of mutant HIV-1 at codon 71 of the protease gene.
  modified_base (2)..(2): base is a locked nucleic acid
  modified_base (9)..(9): base is a locked nucleic acid
  modified_base (10)..(10): base is a locked nucleic acid
ggrmawarrcyataggkwc

SEQ ID NO: 13214 - DNA, 19 bp, Artificial Sequence
  Oligonucleotide probe
  misc_binding (1)..(19): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (10)..(10): base is a locked nucleic acid
ggrmawarrcyataggkwc

SEQ ID NO: 13215 - DNA, 19 bp, Artificial Sequence
  Oligonucleotide probe
  misc_binding (1)..(19): Hybridization probe for the specific detection of mutant HIV-1 at codon 71 of the protease gene.
  modified_base (3)..(3): base is a locked nucleic acid
  modified_base (9)..(9): base is a locked nucleic acid
  modified_base (10)..(10): base is a locked nucleic acid
ggrmawarrcyataggkwc

SEQ ID NO: 13216 - DNA, 19 bp, Artificial Sequence
  Oligonucleotide probe
  misc_binding (1)..(19): Hybridization probe for the specific detection of mutant HIV-1 at codon 71 of the protease gene.
  modified_base (7)..(7): base is a locked nucleic acid
  modified_base (9)..(9): base is a locked nucleic acid
  modified_base (10)..(10): base is a locked nucleic acid
ggrmawarrcyataggkwc

SEQ ID NO: 13217 - DNA, 19 bp, Artificial Sequence
  Oligonucleotide probe
  misc_binding (1)..(19): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (11)..(11): base is a locked nucleic acid
ggrmawarrcyataggkwc

SEQ ID NO: 13218 - DNA, 19 bp, Artificial Sequence
  Oligonucleotide probe
  misc_binding (1)..(19): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (14)..(14): base is a locked nucleic acid
ggrmawarrcyataggkwc

SEQ ID NO: 13219 - DNA, 19 bp, Artificial Sequence
  Oligonucleotide probe
  misc_binding (1)..(19): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (17)..(17): base is a locked nucleic acid
ggrmawarrcyataggkwc

SEQ ID NO: 13220 - DNA, 19 bp, Artificial Sequence
  Oligonucleotide probe
  misc_binding (1)..(19): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (13)..(13): base is a locked nucleic acid
ggrmawarrcyataggkwc

SEQ ID NO: 13221 - DNA, 18 bp, Artificial Sequence
  Oligonucleotide probe
  misc_binding (1)..(18): Hybridization probe for the specific detection of mutant HIV-1 at codon 71 of the protease gene.
  modified_base (9)..(9): base is a locked nucleic acid
  modified_base (10)..(10): base is a locked nucleic acid
ggrmawarrcyataggkw

SEQ ID NO: 13222 - DNA, 18 bp, Artificial Sequence
  Oligonucleotide probe
  misc_binding (1)..(18): Hybridization probe for the specific detection of mutant HIV-1 at codon 71 of the protease gene.
  modified_base (2)..(2): base is a locked nucleic acid
ggrmawarrcyataggkw

SEQ ID NO: 13223 - DNA, 18 bp, Artificial Sequence
  Oligonucleotide probe
  misc_binding (1)..(18): Hybridization probe for the specific detection of mutant HIV-1 at codon 71 of the protease gene.
  modified_base (7)..(7): base is a locked nucleic acid
ggrmawarrcyataggkw

SEQ ID NO: 13224 - DNA, 18 bp, Artificial Sequence
  Oligonucleotide probe
  misc_binding (1)..(18): Hybridization probe for the specific detection of mutant HIV-1 at codon 71 of the protease gene.
  modified_base (4)..(4): base is a locked nucleic acid
ggrmawarrcyataggkw

SEQ ID NO: 13225 - DNA, 18 bp, Artificial Sequence
  Oligonucleotide probe
  misc_binding (1)..(18): Hybridization probe for the specific detection of mutant HIV-1 at codon 71 of the protease gene.
  modified_base (5)..(5): base is a locked nucleic acid
ggrmawarrcyataggkw

SEQ ID NO: 13226 - DNA, 18 bp, Artificial Sequence
  Oligonucleotide probe
  misc_binding (1)..(18): Hybridization probe for the specific detection of mutant HIV-1 at codon 71 of the protease gene.
  modified_base (15)..(15): base is a locked nucleic acid
ggrmawarrcyataggkw

SEQ ID NO: 13227 - DNA, 18 bp, Artificial Sequence
  Oligonucleotide probe
  misc_binding (1)..(18): Hybridization probe for the specific detection of mutant HIV-1 at codon 71 of the protease gene.
  modified_base (16)..(16): base is a locked nucleic acid
ggrmawarrcyataggkw

SEQ ID NO: 13228 - DNA, 18 bp, Artificial Sequence
  Oligonucleotide probe
  misc_binding (1)..(18): Hybridization probe for the specific detection of mutant HIV-1 at codon 71 of the protease gene.
  modified_base (10)..(10): base is a locked nucleic acid
ggrmawarrcyataggkw

SEQ ID NO: 13229 - DNA, 18 bp, Artificial Sequence
  Oligonucleotide probe
  misc_binding (1)..(18): Hybridization probe for the specific detection of mutant HIV-1 at codon 71 of the protease gene.
  modified_base (11)..(11): base is a locked nucleic acid
ggrmawarrcyataggkw

SEQ ID NO: 13230 - DNA, 18 bp, Artificial Sequence
  Oligonucleotide probe
  misc_binding (1)..(18): Hybridization probe for the specific detection of mutant HIV-1 at codon 71 of the protease gene.
  modified_base (2)..(2): base is a locked nucleic acid
  modified_base (9)..(9): base is a locked nucleic acid
  modified_base (10)..(10): base is a locked nucleic acid
ggrmawarrcyataggkw

SEQ ID NO: 13231 - DNA, 18 bp, Artificial Sequence
  Oligonucleotide probe
  misc_binding (1)..(18): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (10)..(10): base is a locked nucleic acid
ggrmawarrcyataggkw

SEQ ID NO: 13232 - DNA, 18 bp, Artificial Sequence
  Oligonucleotide probe
  misc_binding (1)..(18): Hybridization probe for the specific detection of mutant HIV-1 at codon 71 of the protease gene.
  modified_base (3)..(3): base is a locked nucleic acid
  modified_base (9)..(9): base is a locked nucleic acid
  modified_base (10)..(10): base is a locked nucleic acid
ggrmawarrcyataggkw

SEQ ID NO: 13233 - DNA, 18 bp, Artificial Sequence
  Oligonucleotide probe
  misc_binding (1)..(18): Hybridization probe for the specific detection of mutant HIV-1 at codon 71 of the protease gene.
  modified_base (7)..(7): base is a locked nucleic acid
  modified_base (9)..(9): base is a locked nucleic acid
  modified_base (10)..(10): base is a locked nucleic acid
ggrmawarrcyataggkw

SEQ ID NO: 13234 - DNA, 18 bp, Artificial Sequence
  Oligonucleotide probe
  misc_binding (1)..(18): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (11)..(11): base is a locked nucleic acid
ggrmawarrcyataggkw

SEQ ID NO: 13235 - DNA, 18 bp, Artificial Sequence
  Oligonucleotide probe
  misc_binding (1)..(18): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (14)..(14): base is a locked nucleic acid
ggrmawarrcyataggkw

SEQ ID NO: 13236 - DNA, 18 bp, Artificial Sequence
  Oligonucleotide probe
  misc_binding (1)..(18): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (17)..(17): base is a locked nucleic acid
ggrmawarrcyataggkw

SEQ ID NO: 13237 - DNA, 18 bp, Artificial Sequence
  Oligonucleotide probe
  misc_binding (1)..(18): Hybridization probe for the specific detection of mutant HIV-1 at codon 71 of the protease gene.
  modified_base (9)..(9): base is a locked nucleic acid
  modified_base (10)..(10): base is a locked nucleic acid
  modified_base (13)..(13): base is a locked nucleic acid
ggrmawarrcyataggkw

SEQ ID NO: 13238 - DNA, 17 bp, Artificial Sequence
  Oligonucleotide probe
  misc_binding (1)..(17): Hybridization probe for the specific detection of mutant HIV-1 at codon 71 of the protease gene.
  modified_base (8)..(8): base is a locked nucleic acid
  modified_base (9)..(9): base is a locked nucleic acid
grmawarrcyataggkw

SEQ ID NO: 13239 - DNA, 17 bp, Artificial Sequence
  Oligonucleotide probe
  misc_binding (1)..(17): Hybridization probe for the specific detection of mutant HIV-1 at codon 71 of the protease gene.
  modified_base (1)..(1): base is a locked nucleic acid
grmawarrcyataggkw

SEQ ID NO: 13240 - DNA, 17 bp, Artificial Sequence
  Oligonucleotide probe
  misc_binding (1)..(17): Hybridization probe for the specific detection of mutant HIV-1 at codon 71 of the protease gene.
  modified_base (6)..(6): base is a locked nucleic acid
grmawarrcyataggkw

SEQ ID NO: 13241 - DNA, 17 bp, Artificial Sequence
  Oligonucleotide probe
  misc_binding (1)..(17): Hybridization probe for the specific detection of mutant HIV-1 at codon 71 of the protease gene.
  modified_base (3)..(3): base is a locked nucleic acid
grmawarrcyataggkw

SEQ ID NO: 13242 - DNA, 17 bp, Artificial Sequence
  Oligonucleotide probe
  misc_binding (1)..(17): Hybridization probe for the specific detection of mutant HIV-1 at codon 71 of the protease gene.
  modified_base (4)..(4): base is a locked nucleic acid
grmawarrcyataggkw

SEQ ID NO: 13243 - DNA, 17 bp, Artificial Sequence
  Oligonucleotide probe
  misc_binding (1)..(17): Hybridization probe for the specific detection of mutant HIV-1 at codon 71 of the protease gene.
  modified_base (14)..(14): base is a locked nucleic acid
grmawarrcyataggkw

SEQ ID NO: 13244 - DNA, 17 bp, Artificial Sequence
  Oligonucleotide probe
  misc_binding (1)..(17): Hybridization probe for the specific detection of mutant HIV-1 at codon 71 of the protease gene.
  modified_base (15)..(15): base is a locked nucleic acid
grmawarrcyataggkw

SEQ ID NO: 13245 - DNA, 17 bp, Artificial Sequence
  Oligonucleotide probe
  misc_binding (1)..(17): Hybridization probe for the specific detection of mutant HIV-1 at codon 71 of the protease gene.
  modified_base (9)..(9): base is a locked nucleic acid
grmawarrcyataggkw

SEQ ID NO: 13246 - DNA, 17 bp, Artificial Sequence
  Oligonucleotide probe
  misc_binding (1)..(17): Hybridization probe for the specific detection of mutant HIV-1 at codon 71 of the protease gene.
  modified_base (10)..(10): base is a locked nucleic acid
grmawarrcyataggkw

SEQ ID NO: 13247 - DNA, 17 bp, Artificial Sequence
  Oligonucleotide probe
  misc_binding (1)..(17): Hybridization probe for the specific detection of mutant HIV-1 at codon 71 of the protease gene.
  modified_base (1)..(1): base is a locked nucleic acid
  modified_base (8)..(8): base is a locked nucleic acid
  modified_base (9)..(9): base is a locked nucleic acid
grmawarrcyataggkw

SEQ ID NO: 13248 - DNA, 17 bp, Artificial Sequence
  Oligonucleotide probe
  misc_binding (1)..(17): Hybridization probe for the specific detection of mutant HIV-1 at codon 71 of the protease gene.
  modified_base (7)..(7): base is a locked nucleic acid
  modified_base (8)..(8): base is a locked nucleic acid
  modified_base (9)..(9): base is a locked nucleic acid
grmawarrcyataggkw

SEQ ID NO: 13249 - DNA, 17 bp, Artificial Sequence
  Oligonucleotide probe
  misc_binding (1)..(17): Hybridization probe for the specific detection of mutant HIV-1 at codon 71 of the protease gene.
  modified_base (2)..(2): base is a locked nucleic acid
  modified_base (8)..(8): base is a locked nucleic acid
  modified_base (9)..(9): base is a locked nucleic acid
grmawarrcyataggkw

SEQ ID NO: 13250 - DNA, 17 bp, Artificial Sequence
  Oligonucleotide probe
  misc_binding (1)..(17): Hybridization probe for the specific detection of mutant HIV-1 at codon 71 of the protease gene.
  modified_base (6)..(6): base is a locked nucleic acid
  modified_base (8)..(8): base is a locked nucleic acid
  modified_base (9)..(9): base is a locked nucleic acid
grmawarrcyataggkw

SEQ ID NO: 13251 - DNA, 17 bp, Artificial Sequence
  Oligonucleotide probe
  misc_binding (1)..(17): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (10)..(10): base is a locked nucleic acid
grmawarrcyataggkw

SEQ ID NO: 13252 - DNA, 17 bp, Artificial Sequence
  Oligonucleotide probe
  misc_binding (1)..(17): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (13)..(13): base is a locked nucleic acid
grmawarrcyataggkw

SEQ ID NO: 13253 - DNA, 17 bp, Artificial Sequence
  Oligonucleotide probe
  misc_binding (1)..(17): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (16)..(16): base is a locked nucleic acid
grmawarrcyataggkw

SEQ ID NO: 13254 - DNA, 17 bp, Artificial Sequence
  Oligonucleotide probe
  misc_binding (1)..(17): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (12)..(12): base is a locked nucleic acid
grmawarrcyataggkw

SEQ ID NO: 13255 - DNA, 15 bp, Artificial Sequence
  Oligonucleotide probe
  misc_binding (1)..(15): Hybridization probe for the specific detection of mutant HIV-1 at codon 71 of the protease gene.
  modified_base (8)..(8): base is a locked nucleic acid
  modified_base (9)..(9): base is a locked nucleic acid
grmawarrcyatagg

SEQ ID NO: 13256 - DNA, 15 bp, Artificial Sequence
  Oligonucleotide probe
  misc_binding (1)..(15): Hybridization probe for the specific detection of mutant HIV-1 at codon 71 of the protease gene.
  modified_base (1)..(1): base is a locked nucleic acid
grmawarrcyatagg

SEQ ID NO: 13257 - DNA, 15 bp, Artificial Sequence
  Oligonucleotide probe
  misc_binding (1)..(15): Hybridization probe for the specific detection of mutant HIV-1 at codon 71 of the protease gene.
  modified_base (6)..(6): base is a locked nucleic acid
grmawarrcyatagg

SEQ ID NO: 13258 - DNA, 15 bp, Artificial Sequence
  Oligonucleotide probe
  misc_binding (1)..(15): Hybridization probe for the specific detection of mutant HIV-1 at codon 71 of the protease gene.
  modified_base (3)..(3): base is a locked nucleic acid
grmawarrcyatagg

SEQ ID NO: 13259 - DNA, 15 bp, Artificial Sequence
  Oligonucleotide probe
  misc_binding (1)..(15): Hybridization probe for the specific detection of mutant HIV-1 at codon 71 of the protease gene.
  modified_base (4)..(4): base is a locked nucleic acid
grmawarrcyatagg

SEQ ID NO: 13260 - DNA, 15 bp, Artificial Sequence
  Oligonucleotide probe
  misc_binding (1)..(15): Hybridization probe for the specific detection of mutant HIV-1 at codon 71 of the protease gene.
  modified_base (14)..(14): base is a locked nucleic acid
grmawarrcyatagg

SEQ ID NO: 13261 - DNA, 15 bp, Artificial Sequence
  Oligonucleotide probe
  misc_binding (1)..(15): Hybridization probe for the specific detection of mutant HIV-1 at codon 71 of the protease gene.
  modified_base (15)..(15): base is a locked nucleic acid
grmawarrcyatagg

SEQ ID NO: 13262 - DNA, 15 bp, Artificial Sequence
  Oligonucleotide probe
  misc_binding (1)..(15): Hybridization probe for the specific detection of mutant HIV-1 at codon 71 of the protease gene.
  modified_base (9)..(9): base is a locked nucleic acid
grmawarrcyatagg

SEQ ID NO: 13263 - DNA, 15 bp, Artificial Sequence
  Oligonucleotide probe
  misc_binding (1)..(15): Hybridization probe for the specific detection of mutant HIV-1 at codon 71 of the protease gene.
  modified_base (10)..(10): base is a locked nucleic acid
grmawarrcyatagg

SEQ ID NO: 13264 - DNA, 15 bp, Artificial Sequence
  Oligonucleotide probe
  misc_binding (1)..(15): Hybridization probe for the specific detection of mutant HIV-1 at codon 71 of the protease gene.
  modified_base (1)..(1): base is a locked nucleic acid
  modified_base (8)..(8): base is a locked nucleic acid
  modified_base (9)..(9): base is a locked nucleic acid
grmawarrcyatagg

SEQ ID NO: 13265 - DNA, 15 bp, Artificial Sequence
  Oligonucleotide probe
  misc_binding (1)..(15): Hybridization probe for the specific detection of mutant HIV-1 at codon 71 of the protease gene.
  modified_base (7)..(7): base is a locked nucleic acid
  modified_base (8)..(8): base is a locked nucleic acid
  modified_base (9)..(9): base is a locked nucleic acid
grmawarrcyatagg

SEQ ID NO: 13266 - DNA, 15 bp, Artificial Sequence
  Oligonucleotide probe
  misc_binding (1)..(15): Hybridization probe for the specific detection of mutant HIV-1 at codon 71 of the protease gene.
  modified_base (2)..(2): base is a locked nucleic acid
  modified_base (8)..(8): base is a locked nucleic acid
  modified_base (9)..(9): base is a locked nucleic acid
grmawarrcyatagg

SEQ ID NO: 13267 - DNA, 15 bp, Artificial Sequence
  Oligonucleotide probe
  misc_binding (1)..(15): Hybridization probe for the specific detection of mutant HIV-1 at codon 71 of the protease gene.
  modified_base (6)..(6): base is a locked nucleic acid
  modified_base (8)..(8): base is a locked nucleic acid
  modified_base (9)..(9): base is a locked nucleic acid
grmawarrcyatagg

SEQ ID NO: 13268 - DNA, 15 bp, Artificial Sequence
  Oligonucleotide probe
  misc_binding (1)..(15): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (10)..(10): base is a locked nucleic acid
grmawarrcyatagg

SEQ ID NO: 13269 - DNA, 15 bp, Artificial Sequence
  Oligonucleotide probe
  misc_binding (1)..(15): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (13)..(13): base is a locked nucleic acid
grmawarrcyatagg

SEQ ID NO: 13270 - DNA, 15 bp, Artificial Sequence
  Oligonucleotide probe
  misc_binding (1)..(15): Hybridization probe for the specific detection of mutant HIV-1 at codon 71 of the protease gene.
  modified_base (8)..(8): base is a locked nucleic acid
  modified_base (9)..(9): base is a locked nucleic acid
grmawarrcyatagg

SEQ ID NO: 13271 - DNA, 15 bp, Artificial Sequence
  Oligonucleotide probe
  misc_binding (1)..(15): Hybridization probe for the specific detection of mutant HIV-1 at codon 71 of the protease gene.
  modified_base (8)..(8): base is a locked nucleic acid
  modified_base (9)..(9): base is a locked nucleic acid
  modified_base (12)..(12): base is a locked nucleic acid
grmawarrcyatagg

SEQ ID NO: 13272 - DNA, 15 bp, Artificial Sequence
  Oligonucleotide probe
  misc_binding (1)..(15): Hybridization probe for the specific detection of mutant HIV-1 at codon 71 of the protease gene.
cataaaathataggt

SEQ ID NO: 13273 - DNA, 15 bp, Artificial Sequence
  Oligonucleotide probe
  misc_binding (1)..(15): Hybridization probe for the specific detection of mutant HIV-1 at codon 71 of the protease gene.
cataaacthataggt

SEQ ID NO: 13274 - DNA, 15 bp, Artificial Sequence
  Oligonucleotide probe
  misc_binding (1)..(15): Hybridization probe for the specific detection of mutant HIV-1 at codon 71 of the protease gene.
cataaattaataggt

SEQ ID NO: 13275 - DNA, 19 bp, Artificial Sequence
  Oligonucleotide probe
  misc_binding (1)..(19): Hybridization probe for the specific detection of mutant HIV-1 at codon 71 of the protease gene.
ggrmawarrcyataggkwc

SEQ ID NO: 13276 - DNA, 18 bp, Artificial Sequence
  Oligonucleotide probe
  misc_binding (1)..(18): Hybridization probe for the specific detection of mutant HIV-1 at codon 71 of the protease gene.
ggrmawarrcyataggkw

SEQ ID NO: 13277 - DNA, 17 bp, Artificial Sequence
  Oligonucleotide probe
  misc_binding (1)..(17): Hybridization probe for the specific detection of mutant HIV-1 at codon 71 of the protease gene.
grmawarrcyataggkw

SEQ ID NO: 13278 - DNA, 15 bp, Artificial Sequence
  Oligonucleotide probe
  misc_binding (1)..(15): Hybridization probe for the specific detection of mutant HIV-1 at codon 71 of the protease gene.
grmawarrcyatagg

SEQ ID NO: 13279 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
rrgcyatagkwcagtrytr

SEQ ID NO: 13280 - DNA, 19 bp, Artificial Sequence
  Oligonucleotide probe
  misc_binding (1)..(19): Hybridization probe for the specific detection of mutant HIV-1 at codon 73 of the protease gene.
  modified_base (4)..(4): base is a locked nucleic acid
rrgcyatagkwcagtrytr

SEQ ID NO: 13281 - DNA, 19 bp, Artificial Sequence
  Oligonucleotide probe
  misc_binding (1)..(19): Hybridization probe for the specific detection of mutant HIV-1 at codon 73 of the protease gene.
  modified_base (2)..(2): base is a locked nucleic acid
rrgcyatagkwcagtrytr

SEQ ID NO: 13282 - DNA, 19 bp, Artificial Sequence
  Oligonucleotide probe
  misc_binding (1)..(19): Hybridization probe for the specific detection of mutant HIV-1 at codon 73 of the protease gene.
  modified_base (5)..(5): base is a locked nucleic acid
rrgcyatagkwcagtrytr

SEQ ID NO: 13283 - DNA, 19 bp, Artificial Sequence
  Oligonucleotide probe
  misc_binding (1)..(19): Hybridization probe for the specific detection of mutant HIV-1 at codon 73 of the protease gene.
  modified_base (8)..(8): base is a locked nucleic acid
rrgcyatagkwcagtrytr

SEQ ID NO: 13284 - DNA, 19 bp, Artificial Sequence
  Oligonucleotide probe
  misc_binding (1)..(19): Hybridization probe for the specific detection of mutant HIV-1 at codon 73 of the protease gene.
  modified_base (18)..(18): base is a locked nucleic acid
rrgcyatagkwcagtrytr

SEQ ID NO: 13285 - DNA, 19 bp, Artificial Sequence
  Oligonucleotide probe
  misc_binding (1)..(19): Hybridization probe for the specific detection of mutant HIV-1 at codon 73 of the protease gene.
  modified_base (10)..(10): base is a locked nucleic acid
rrgcyatagkwcagtrytr

SEQ ID NO: 13286 - DNA, 19 bp, Artificial Sequence
  Oligonucleotide probe
  misc_binding (1)..(19): Hybridization probe for the specific detection of mutant HIV-1 at codon 73 of the protease gene.
  modified_base (13)..(13): base is a locked nucleic acid
rrgcyatagkwcagtrytr

SEQ ID NO: 13287 - DNA, 19 bp, Artificial Sequence
  Oligonucleotide probe
  misc_binding (1)..(19): Hybridization probe for the specific detection of mutant HIV-1 at codon 73 of the protease gene.
  modified_base (11)..(11): base is a locked nucleic acid
rrgcyatagkwcagtrytr

SEQ ID NO: 13288 - DNA, 19 bp, Artificial Sequence
  Oligonucleotide probe
  misc_binding (1)..(19): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (10)..(10): base is a locked nucleic acid
rrgcyatagkwcagtrytr

SEQ ID NO: 13289 - DNA, 19 bp, Artificial Sequence
  Oligonucleotide probe
  misc_binding (1)..(19): Hybridization probe for the specific detection of mutant HIV-1 at codon 73 of the protease gene.
  modified_base (6)..(6): base is a locked nucleic acid
  modified_base (9)..(9): base is a locked nucleic acid
  modified_base (10)..(10): base is a locked nucleic acid
rrgcyatagkwcagtrytr

SEQ ID NO: 13290 - DNA, 19 bp, Artificial Sequence
  Oligonucleotide probe
  misc_binding (1)..(19): Hybridization probe for the specific detection of mutant HIV-1 at codon 73 of the protease gene.
  modified_base (3)..(3): base is a locked nucleic acid
  modified_base (9)..(9): base is a locked nucleic acid
  modified_base (10)..(10): base is a locked nucleic acid
rrgcyatagkwcagtrytr

SEQ ID NO: 13291 - DNA, 19 bp, Artificial Sequence
  Oligonucleotide probe
  misc_binding (1)..(19): Hybridization probe for the specific detection of mutant HIV-1 at codon 73 of the protease gene.
  modified_base (4)..(4): base is a locked nucleic acid
  modified_base (9)..(9): base is a locked nucleic acid
  modified_base (10)..(10): base is a locked nucleic acid
rrgcyatagkwcagtrytr

SEQ ID NO: 13292 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (13)..(13): base is a locked nucleic acid
rrgcyatagkwcagtrytr

SEQ ID NO: 13293 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (11)..(11): base is a locked nucleic acid
rrgcyatagkwcagtrytr

SEQ ID NO: 13294 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (17)..(17): base is a locked nucleic acid
rrgcyatagkwcagtrytr

SEQ ID NO: 13295 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (12)..(12): base is a locked nucleic acid
rrgcyatagkwcagtrytr

SEQ ID NO: 13296 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
arrgcyatagkwcagtryt

SEQ ID NO: 13297 - DNA, 19 bp, Artificial Sequence
  Oligonucleotide probe
  misc_binding (1)..(19): Hybridization probe for the specific detection of mutant HIV-1 at codon 73 of the protease gene.
  modified_base (8)..(8): base is a locked nucleic acid
arrgcyatagkwcagtryt

SEQ ID NO: 13298 - DNA, 19 bp, Artificial Sequence
  Oligonucleotide probe
  misc_binding (1)..(19): Hybridization probe for the specific detection of mutant HIV-1 at codon 73 of the protease gene.
  modified_base (2)..(2): base is a locked nucleic acid
arrgcyatagkwcagtryt

SEQ ID NO: 13299 - DNA, 19 bp, Artificial Sequence
  Oligonucleotide probe
  misc_binding (1)..(19): Hybridization probe for the specific detection of mutant HIV-1 at codon 73 of the protease gene.
  modified_base (3)..(3): base is a locked nucleic acid
arrgcyatagkwcagtryt

SEQ ID NO: 13300 - DNA, 19 bp, Artificial Sequence
  Oligonucleotide probe
  misc_binding (1)..(19): Hybridization probe for the specific detection of mutant HIV-1 at codon 73 of the protease gene.
  modified_base (5)..(5): base is a locked nucleic acid
arrgcyatagkwcagtryt

SEQ ID NO: 13301 - DNA, 19 bp, Artificial Sequence
  Oligonucleotide probe
  misc_binding (1)..(19): Hybridization probe for the specific detection of mutant HIV-1 at codon 73 of the protease gene.
  modified_base (14)..(14): base is a locked nucleic acid
arrgcyatagkwcagtryt

SEQ ID NO: 13302 - DNA, 19 bp, Artificial Sequence
  Oligonucleotide probe
  misc_binding (1)..(19): Hybridization probe for the specific detection of mutant HIV-1 at codon 73 of the protease gene.
  modified_base (12)..(12): base is a locked nucleic acid
arrgcyatagkwcagtryt

SEQ ID NO: 13303 - DNA, 19 bp, Artificial Sequence
  Oligonucleotide probe
  misc_binding (1)..(19): Hybridization probe for the specific detection of mutant HIV-1 at codon 73 of the protease gene.
  modified_base (11)..(11): base is a locked nucleic acid
arrgcyatagkwcagtryt

SEQ ID NO: 13304 - DNA, 19 bp, Artificial Sequence
  Oligonucleotide probe
  misc_binding (1)..(19): Hybridization probe for the specific detection of mutant HIV-1 at codon 73 of the protease gene.
  modified_base (18)..(18): base is a locked nucleic acid
arrgcyatagkwcagtryt

SEQ ID NO: 13305 - DNA, 19 bp, Artificial Sequence
  Oligonucleotide probe
  misc_binding (1)..(19): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (10)..(10): base is a locked nucleic acid
arrgcyatagkwcagtryt

SEQ ID NO: 13306 - DNA, 19 bp, Artificial Sequence
  Oligonucleotide probe
  misc_binding (1)..(19): Hybridization probe for the specific detection of mutant HIV-1 at codon 73 of the protease gene.
  modified_base (5)..(5): base is a locked nucleic acid
  modified_base (9)..(9): base is a locked nucleic acid
  modified_base (10)..(10): base is a locked nucleic acid
arrgcyatagkwcagtryt

SEQ ID NO: 13307 - DNA, 19 bp, Artificial Sequence
  Oligonucleotide probe
  misc_binding (1)..(19): Hybridization probe for the specific detection of mutant HIV-1 at codon 73 of the protease gene.
  modified_base (2)..(2): base is a locked nucleic acid
  modified_base (9)..(9): base is a locked nucleic acid
  modified_base (10)..(10): base is a locked nucleic acid
arrgcyatagkwcagtryt

SEQ ID NO: 13308 - DNA, 19 bp, Artificial Sequence
  Oligonucleotide probe
  misc_binding (1)..(19): Hybridization probe for the specific detection of mutant HIV-1 at codon 73 of the protease gene.
  modified_base (7)..(7): base is a locked nucleic acid
  modified_base (9)..(9): base is a locked nucleic acid
  modified_base (10)..(10): base is a locked nucleic acid
arrgcyatagkwcagtryt

SEQ ID NO: 13309 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (14)..(14): base is a locked nucleic acid
arrgcyatagkwcagtryt

SEQ ID NO: 13310 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (18)..(18): base is a locked nucleic acid
arrgcyatagkwcagtryt

SEQ ID NO: 13311 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (13)..(13): base is a locked nucleic acid
arrgcyatagkwcagtryt

SEQ ID NO: 13312 - DNA, 19 bp, Artificial Sequence
  Oligonucleotide probe
  misc_binding (1)..(19): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (12)..(12): base is a locked nucleic acid
arrgcyatagkwcagtryt

SEQ ID NO: 13313 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
rrgcyatagkwcagtryt

SEQ ID NO: 13314 - DNA, 18 bp, Artificial Sequence
  Oligonucleotide probe
  misc_binding (1)..(18): Hybridization probe for the specific detection of mutant HIV-1 at codon 73 of the protease gene.
  modified_base (4)..(4): base is a locked nucleic acid
rrgcyatagkwcagtryt

SEQ ID NO: 13315 - DNA, 18 bp, Artificial Sequence
  Oligonucleotide probe
  misc_binding (1)..(18): Hybridization probe for the specific detection of mutant HIV-1 at codon 73 of the protease gene.
  modified_base (2)..(2): base is a locked nucleic acid
rrgcyatagkwcagtryt

SEQ ID NO: 13316 - DNA, 18 bp, Artificial Sequence
  Oligonucleotide probe
  misc_binding (1)..(18): Hybridization probe for the specific detection of mutant HIV-1 at codon 73 of the protease gene.
  modified_base (5)..(5): base is a locked nucleic acid
rrgcyatagkwcagtryt

SEQ ID NO: 13317 - DNA, 18 bp, Artificial Sequence
  Oligonucleotide probe
  misc_binding (1)..(18): Hybridization probe for the specific detection of mutant HIV-1 at codon 73 of the protease gene.
  modified_base (8)..(8): base is a locked nucleic acid
rrgcyatagkwcagtryt

SEQ ID NO: 13318 - DNA, 18 bp, Artificial Sequence
  Oligonucleotide probe
  misc_binding (1)..(18): Hybridization probe for the specific detection of mutant HIV-1 at codon 73 of the protease gene.
  modified_base (18)..(18): base is a locked nucleic acid
rrgcyatagkwcagtryt

SEQ ID NO: 13319 - DNA, 18 bp, Artificial Sequence
  Oligonucleotide probe
  misc_binding (1)..(18): Hybridization probe for the specific detection of mutant HIV-1 at codon 73 of the protease gene.
  modified_base (10)..(10): base is a locked nucleic acid
rrgcyatagkwcagtryt

SEQ ID NO: 13320 - DNA, 18 bp, Artificial Sequence
  Oligonucleotide probe
  misc_binding (1)..(18): Hybridization probe for the specific detection of mutant HIV-1 at codon 73 of the protease gene.
  modified_base (13)..(13): base is a locked nucleic acid
rrgcyatagkwcagtryt

SEQ ID NO: 13321 - DNA, 18 bp, Artificial Sequence
  Oligonucleotide probe
  misc_binding (1)..(18): Hybridization probe for the specific detection of mutant HIV-1 at codon 73 of the protease gene.
  modified_base (11)..(11): base is a locked nucleic acid
rrgcyatagkwcagtryt

SEQ ID NO: 13322 - DNA, 18 bp, Artificial Sequence
  Oligonucleotide probe
  misc_binding (1)..(18): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (10)..(10): base is a locked nucleic acid
rrgcyatagkwcagtryt

SEQ ID NO: 13323 - DNA, 18 bp, Artificial Sequence
  Oligonucleotide probe
  misc_binding (1)..(18): Hybridization probe for the specific detection of mutant HIV-1 at codon 73 of the protease gene.
  modified_base (6)..(6): base is a locked nucleic acid
  modified_base (9)..(9): base is a locked nucleic acid
  modified_base (10)..(10): base is a locked nucleic acid
rrgcyatagkwcagtryt

SEQ ID NO: 13324 - DNA, 18 bp, Artificial Sequence
  Oligonucleotide probe
  misc_binding (1)..(18): Hybridization probe for the specific detection of mutant HIV-1 at codon 73 of the protease gene.
  modified_base (3)..(3): base is a locked nucleic acid
  modified_base (9)..(9): base is a locked nucleic acid
  modified_base (10)..(10): base is a locked nucleic acid
rrgcyatagkwcagtryt

SEQ ID NO: 13325 - DNA, 18 bp, Artificial Sequence
  Oligonucleotide probe
  misc_binding (1)..(18): Hybridization probe for the specific detection of mutant HIV-1 at codon 73 of the protease gene.
  modified_base (4)..(4): base is a locked nucleic acid
  modified_base (9)..(9): base is a locked nucleic acid
  modified_base (10)..(10): base is a locked nucleic acid
rrgcyatagkwcagtryt

SEQ ID NO: 13326 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (13)..(13): base is a locked nucleic acid
rrgcyatagkwcagtryt

SEQ ID NO: 13327 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (11)..(11): base is a locked nucleic acid
rrgcyatagkwcagtryt

SEQ ID NO: 13328 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (17)..(17): base is a locked nucleic acid
rrgcyatagkwcagtryt

SEQ ID NO: 13329 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (12)..(12): base is a locked nucleic acid
rrgcyatagkwcagtryt

SEQ ID NO: 13330 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
arrgcyatagkwcagtry

SEQ ID NO: 13331 - DNA, 18 bp, Artificial Sequence
  Oligonucleotide probe
  misc_binding (1)..(18): Hybridization probe for the specific detection of mutant HIV-1 at codon 73 of the protease gene.
  modified_base (8)..(8): base is a locked nucleic acid
arrgcyatagkwcagtry

SEQ ID NO: 13332 - DNA, 18 bp, Artificial Sequence
  Oligonucleotide probe
  misc_binding (1)..(18): Hybridization probe for the specific detection of mutant HIV-1 at codon 73 of the protease gene.
  modified_base (2)..(2): base is a locked nucleic acid
arrgcyatagkwcagtry

SEQ ID NO: 13333 - DNA, 18 bp, Artificial Sequence
  Oligonucleotide probe
  misc_binding (1)..(18): Hybridization probe for the specific detection of mutant HIV-1 at codon 73 of the protease gene.
  modified_base (3)..(3): base is a locked nucleic acid
arrgcyatagkwcagtry

SEQ ID NO: 13334 - DNA, 18 bp, Artificial Sequence
  Oligonucleotide probe
  misc_binding (1)..(18): Hybridization probe for the specific detection of mutant HIV-1 at codon 73 of the protease gene.
  modified_base (5)..(5): base is a locked nucleic acid
arrgcyatagkwcagtry

SEQ ID NO: 13335 - DNA, 18 bp, Artificial Sequence
  Oligonucleotide probe
  misc_binding (1)..(18): Hybridization probe for the specific detection of mutant HIV-1 at codon 73 of the protease gene.
  modified_base (14)..(14): base is a locked nucleic acid
arrgcyatagkwcagtry

SEQ ID NO: 13336 - DNA, 18 bp, Artificial Sequence
  Oligonucleotide probe
  misc_binding (1)..(18): Hybridization probe for the specific detection of mutant HIV-1 at codon 73 of the protease gene.
  modified_base (12)..(12): base is a locked nucleic acid
arrgcyatagkwcagtry

SEQ ID NO: 13337 - DNA, 18 bp, Artificial Sequence
  Oligonucleotide probe
  misc_binding (1)..(18): Hybridization probe for the specific detection of mutant HIV-1 at codon 73 of the protease gene.
  modified_base (11)..(11): base is a locked nucleic acid
arrgcyatagkwcagtry

SEQ ID NO: 13338 - DNA, 18 bp, Artificial Sequence
  Oligonucleotide probe
  misc_binding (1)..(18): Hybridization probe for the specific detection of mutant HIV-1 at codon 73 of the protease gene.
  modified_base (18)..(18): base is a locked nucleic acid
arrgcyatagkwcagtry

SEQ ID NO: 13339 - DNA, 18 bp, Artificial Sequence
  Oligonucleotide probe
  misc_binding (1)..(18): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (10)..(10): base is a locked nucleic acid
arrgcyatagkwcagtry

SEQ ID NO: 13340 - DNA, 18 bp, Artificial Sequence
  Oligonucleotide probe
  misc_binding (1)..(18): Hybridization probe for the specific detection of mutant HIV-1 at codon 73 of the protease gene.
  modified_base (5)..(5): base is a locked nucleic acid
  modified_base (9)..(9): base is a locked nucleic acid
  modified_base (10)..(10): base is a locked nucleic acid
arrgcyatagkwcagtry

SEQ ID NO: 13341 - DNA, 18 bp, Artificial Sequence
  Oligonucleotide probe
  misc_binding (1)..(18): Hybridization probe for the specific detection of mutant HIV-1 at codon 73 of the protease gene.
  modified_base (2)..(2): base is a locked nucleic acid
  modified_base (9)..(9): base is a locked nucleic acid
  modified_base (10)..(10): base is a locked nucleic acid
arrgcyatagkwcagtry

SEQ ID NO: 13342 - DNA, 18 bp, Artificial Sequence
  Oligonucleotide probe
  misc_binding (1)..(18): Hybridization probe for the specific detection of mutant HIV-1 at codon 73 of the protease gene.
  modified_base (7)..(7): base is a locked nucleic acid
  modified_base (9)..(9): base is a locked nucleic acid
  modified_base (10)..(10): base is a locked nucleic acid
arrgcyatagkwcagtry

SEQ ID NO: 13343 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (14)..(14): base is a locked nucleic acid
arrgcyatagkwcagtry

SEQ ID NO: 13344 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (18)..(18): base is a locked nucleic acid
arrgcyatagkwcagtry

SEQ ID NO: 13345 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (13)..(13): base is a locked nucleic acid
arrgcyatagkwcagtry

SEQ ID NO: 13346 - DNA, 18 bp, Artificial Sequence
  Oligonucleotide probe
  misc_binding (1)..(18): Hybridization probe for the specific detection of mutant HIV-1 at codon 73 of the protease gene.
  modified_base (9)..(9): base is a locked nucleic acid
  modified_base (10)..(10): base is a locked nucleic acid
  modified_base (12)..(12): base is a locked nucleic acid
arrgcyatagkwcagtry

SEQ ID NO: 13347 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
rgcyatagkwcagtryt

SEQ ID NO: 13348 - DNA, 17 bp, Artificial Sequence
  Oligonucleotide probe
  misc_binding (1)..(17): Hybridization probe for the specific detection of mutant HIV-1 at codon 73 of the protease gene.
  modified_base (3)..(3): base is a locked nucleic acid
rgcyatagkwcagtryt

SEQ ID NO: 13349 - DNA, 17 bp, Artificial Sequence
  Oligonucleotide probe
  misc_binding (1)..(17): Hybridization probe for the specific detection of mutant HIV-1 at codon 73 of the protease gene.
  modified_base (1)..(1): base is a locked nucleic acid
rgcyatagkwcagtryt

SEQ ID NO: 13350 - DNA, 17 bp, Artificial Sequence
  Oligonucleotide probe
  misc_binding (1)..(17): Hybridization probe for the specific detection of mutant HIV-1 at codon 73 of the protease gene.
  modified_base (4)..(4): base is a locked nucleic acid
rgcyatagkwcagtryt

SEQ ID NO: 13351 - DNA, 17 bp, Artificial Sequence
  Oligonucleotide probe
  misc_binding (1)..(17): Hybridization probe for the specific detection of mutant HIV-1 at codon 73 of the protease gene.
  modified_base (7)..(7): base is a locked nucleic acid
rgcyatagkwcagtryt

SEQ ID NO: 13352 - DNA, 17 bp, Artificial Sequence
  Oligonucleotide probe
  misc_binding (1)..(17): Hybridization probe for the specific detection of mutant HIV-1 at codon 73 of the protease gene.
  modified_base (17)..(17): base is a locked nucleic acid
rgcyatagkwcagtryt

SEQ ID NO: 13353 - DNA, 17 bp, Artificial Sequence
  Oligonucleotide probe
  misc_binding (1)..(17): Hybridization probe for the specific detection of mutant HIV-1 at codon 73 of the protease gene.
  modified_base (9)..(9): base is a locked nucleic acid
rgcyatagkwcagtryt

SEQ ID NO: 13354 - DNA, 17 bp, Artificial Sequence
  Oligonucleotide probe
  misc_binding (1)..(17): Hybridization probe for the specific detection of mutant HIV-1 at codon 73 of the protease gene.
  modified_base (12)..(12): base is a locked nucleic acid
rgcyatagkwcagtryt

SEQ ID NO: 13355 - DNA, 17 bp, Artificial Sequence
  Oligonucleotide probe
  misc_binding (1)..(17): Hybridization probe for the specific detection of mutant HIV-1 at codon 73 of the protease gene.
  modified_base (10)..(10): base is a locked nucleic acid
rgcyatagkwcagtryt

SEQ ID NO: 13356 - DNA, 17 bp, Artificial Sequence
  Oligonucleotide probe
  misc_binding (1)..(17): Hybridization probe for the specific detection of mutant HIV-1 at codon 73 of the protease gene.
  modified_base (7)..(7): base is a locked nucleic acid
  modified_base (8)..(8): base is a locked nucleic acid
  modified_base (9)..(9): base is a locked nucleic acid
rgcyatagkwcagtryt

SEQ ID NO: 13357 - DNA, 17 bp, Artificial Sequence
  Oligonucleotide probe
  misc_binding (1)..(17): Hybridization probe for the specific detection of mutant HIV-1 at codon 73 of the protease gene.
  modified_base (5)..(5): base is a locked nucleic acid
  modified_base (8)..(8): base is a locked nucleic acid
  modified_base (9)..(9): base is a locked nucleic acid
rgcyatagkwcagtryt

SEQ ID NO: 13358 - DNA, 17 bp, Artificial Sequence
  Oligonucleotide probe
  misc_binding (1)..(17): Hybridization probe for the specific detection of mutant HIV-1 at codon 73 of the protease gene.
  modified_base (2)..(2): base is a locked nucleic acid
  modified_base (8)..(8): base is a locked nucleic acid
  modified_base (9)..(9): base is a locked nucleic acid
rgcyatagkwcagtryt

SEQ ID NO: 13359 - DNA, 17 bp, Artificial Sequence
  Oligonucleotide probe
  misc_binding (1)..(17): Hybridization probe for the specific detection of mutant HIV-1 at codon 73 of the protease gene.
  modified_base (3)..(3): base is a locked nucleic acid
  modified_base (8)..(8): base is a locked nucleic acid
  modified_base (9)..(9): base is a locked nucleic acid
rgcyatagkwcagtryt

SEQ ID NO: 13360 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (12)..(12): base is a locked nucleic acid
rgcyatagkwcagtryt

SEQ ID NO: 13361 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (10)..(10): base is a locked nucleic acid
rgcyatagkwcagtryt

SEQ ID NO: 13362 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (16)..(16): base is a locked nucleic acid
rgcyatagkwcagtryt

SEQ ID NO: 13363 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
rgcyatagkwcagtryt

SEQ ID NO: 13364 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
rrgcyatagkwcagtry

SEQ ID NO: 13365 - DNA, 17 bp, Artificial Sequence
  Oligonucleotide probe
  misc_binding (1)..(17): Hybridization probe for the specific detection of mutant HIV-1 at codon 73 of the protease gene.
  modified_base (7)..(7): base is a locked nucleic acid
rrgcyatagkwcagtry

SEQ ID NO: 13366 - DNA, 17 bp, Artificial Sequence
  Oligonucleotide probe
  misc_binding (1)..(17): Hybridization probe for the specific detection of mutant HIV-1 at codon 73 of the protease gene.
  modified_base (1)..(1): base is a locked nucleic acid
rrgcyatagkwcagtry

SEQ ID NO: 13367 - DNA, 17 bp, Artificial Sequence
  Oligonucleotide probe
  misc_binding (1)..(17): Hybridization probe for the specific detection of mutant HIV-1 at codon 73 of the protease gene.
  modified_base (2)..(2): base is a locked nucleic acid
rrgcyatagkwcagtry

SEQ ID NO: 13368 - DNA, 17 bp, Artificial Sequence
  Oligonucleotide probe
  misc_binding (1)..(17): Hybridization probe for the specific detection of mutant HIV-1 at codon 73 of the protease gene.
  modified_base (4)..(4): base is a locked nucleic acid
rrgcyatagkwcagtry

SEQ ID NO: 13369 - DNA, 17 bp, Artificial Sequence
  Oligonucleotide probe
  misc_binding (1)..(17): Hybridization probe for the specific detection of mutant HIV-1 at codon 73 of the protease gene.
  modified_base (13)..(13): base is a locked nucleic acid
rrgcyatagkwcagtry

SEQ ID NO: 13370 - DNA, 17 bp, Artificial Sequence
  Oligonucleotide probe
  misc_binding (1)..(17): Hybridization probe for the specific detection of mutant HIV-1 at codon 73 of the protease gene.
  modified_base (11)..(11): base is a locked nucleic acid
rrgcyatagkwcagtry

SEQ ID NO: 13371 - DNA, 17 bp, Artificial Sequence
  Oligonucleotide probe
  misc_binding (1)..(17): Hybridization probe for the specific detection of mutant HIV-1 at codon 73 of the protease gene.
  modified_base (10)..(10): base is a locked nucleic acid
rrgcyatagkwcagtry

SEQ ID NO: 13372 - DNA, 17 bp, Artificial Sequence
  Oligonucleotide probe
  misc_binding (1)..(17): Hybridization probe for the specific detection of mutant HIV-1 at codon 73 of the protease gene.
  modified_base (17)..(17): base is a locked nucleic acid
rrgcyatagkwcagtry

SEQ ID NO: 13373 - DNA, 17 bp, Artificial Sequence
  Oligonucleotide probe
  misc_binding (1)..(17): Hybridization probe for the specific detection of mutant HIV-1 at codon 73 of the protease gene.
  modified_base (7)..(7): base is a locked nucleic acid
  modified_base (8)..(8): base is a locked nucleic acid
  modified_base (9)..(9): base is a locked nucleic acid
rrgcyatagkwcagtry

SEQ ID NO: 13374 - DNA, 17 bp, Artificial Sequence
  Oligonucleotide probe
  misc_binding (1)..(17): Hybridization probe for the specific detection of mutant HIV-1 at codon 73 of the protease gene.
  modified_base (4)..(4): base is a locked nucleic acid
  modified_base (8)..(8): base is a locked nucleic acid
  modified_base (9)..(9): base is a locked nucleic acid
rrgcyatagkwcagtry

SEQ ID NO: 13375 - DNA, 17 bp, Artificial Sequence
  Oligonucleotide probe
  misc_binding (1)..(17): Hybridization probe for the specific detection of mutant HIV-1 at codon 73 of the protease gene.
  modified_base (1)..(1): base is a locked nucleic acid
  modified_base (8)..(8): base is a locked nucleic acid
  modified_base (9)..(9): base is a locked nucleic acid
rrgcyatagkwcagtry

SEQ ID NO: 13376 - DNA, 17 bp, Artificial Sequence
  Oligonucleotide probe
  misc_binding (1)..(17): Hybridization probe for the specific detection of mutant HIV-1 at codon 73 of the protease gene.
  modified_base (6)..(6): base is a locked nucleic acid
  modified_base (8)..(8): base is a locked nucleic acid
  modified_base (9)..(9): base is a locked nucleic acid
rrgcyatagkwcagtry

SEQ ID NO: 13377 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (13)..(13): base is a locked nucleic acid
rrgcyatagkwcagtry

SEQ ID NO: 13378 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (17)..(17): base is a locked nucleic acid
rrgcyatagkwcagtry

SEQ ID NO: 13379 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (12)..(12): base is a locked nucleic acid
rrgcyatagkwcagtry

SEQ ID NO: 13380 - DNA, 17 bp, Artificial Sequence
  Oligonucleotide probe
  misc_binding (1)..(17): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
rrgcyatagkwcagtry

SEQ ID NO: 13381 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
rgcyatagkwcagtr

SEQ ID NO: 13382 - DNA, 15 bp, Artificial Sequence
  Oligonucleotide probe
  misc_binding (1)..(15): Hybridization probe for the specific detection of mutant HIV-1 at codon 73 of the protease gene.
  modified_base (3)..(3): base is a locked nucleic acid
rgcyatagkwcagtr

SEQ ID NO: 13383 - DNA, 15 bp, Artificial Sequence
  Oligonucleotide probe
  misc_binding (1)..(15): Hybridization probe for the specific detection of mutant HIV-1 at codon 73 of the protease gene.
  modified_base (1)..(1): base is a locked nucleic acid
rgcyatagkwcagtr

SEQ ID NO: 13384 - DNA, 15 bp, Artificial Sequence
  Oligonucleotide probe
  misc_binding (1)..(15): Hybridization probe for the specific detection of mutant HIV-1 at codon 73 of the protease gene.
  modified_base (4)..(4): base is a locked nucleic acid
rgcyatagkwcagtr

SEQ ID NO: 13385 - DNA, 15 bp, Artificial Sequence
  Oligonucleotide probe
  misc_binding (1)..(15): Hybridization probe for the specific detection of mutant HIV-1 at codon 73 of the protease gene.
  modified_base (7)..(7): base is a locked nucleic acid
rgcyatagkwcagtr

SEQ ID NO: 13386 - DNA, 16 bp, Artificial Sequence
  Oligonucleotide probe
  misc_binding (1)..(16): Hybridization probe for the specific detection of mutant HIV-1 at codon 73 of the protease gene.
rgcyatagkwcagtry

SEQ ID NO: 13387 - DNA, 15 bp, Artificial Sequence
  Oligonucleotide probe
  misc_binding (1)..(15): Hybridization probe for the specific detection of mutant HIV-1 at codon 73 of the protease gene.
  modified_base (9)..(9): base is a locked nucleic acid
rgcyatagkwcagtr

SEQ ID NO: 13388 - DNA, 15 bp, Artificial Sequence
  Oligonucleotide probe
  misc_binding (1)..(15): Hybridization probe for the specific detection of mutant HIV-1 at codon 73 of the protease gene.
  modified_base (12)..(12): base is a locked nucleic acid
rgcyatagkwcagtr

SEQ ID NO: 13389 - DNA, 15 bp, Artificial Sequence
  Oligonucleotide probe
  misc_binding (1)..(15): Hybridization probe for the specific detection of mutant HIV-1 at codon 73 of the protease gene.
  modified_base (10)..(10): base is a locked nucleic acid
rgcyatagkwcagtr

SEQ ID NO: 13390 - DNA, 15 bp, Artificial Sequence
  Oligonucleotide probe
  misc_binding (1)..(15): Hybridization probe for the specific detection of mutant HIV-1 at codon 73 of the protease gene.
  modified_base (7)..(7): base is a locked nucleic acid
  modified_base (8)..(8): base is a locked nucleic acid
  modified_base (9)..(9): base is a locked nucleic acid
rgcyatagkwcagtr

SEQ ID NO: 13391 - DNA, 15 bp, Artificial Sequence
  Oligonucleotide probe
  misc_binding (1)..(15): Hybridization probe for the specific detection of mutant HIV-1 at codon 73 of the protease gene.
  modified_base (5)..(5): base is a locked nucleic acid
  modified_base (8)..(8): base is a locked nucleic acid
  modified_base (9)..(9): base is a locked nucleic acid
rgcyatagkwcagtr

SEQ ID NO: 13392 - DNA, 15 bp, Artificial Sequence
  Oligonucleotide probe
  misc_binding (1)..(15): Hybridization probe for the specific detection of mutant HIV-1 at codon 73 of the protease gene.
  modified_base (2)..(2): base is a locked nucleic acid
  modified_base (8)..(8): base is a locked nucleic acid
  modified_base (9)..(9): base is a locked nucleic acid
rgcyatagkwcagtr

SEQ ID NO: 13393 - DNA, 15 bp, Artificial Sequence
  Oligonucleotide probe
  misc_binding (1)..(15): Hybridization probe for the specific detection of mutant HIV-1 at codon 73 of the protease gene.
  modified_base (3)..(3): base is a locked nucleic acid
  modified_base (8)..(8): base is a locked nucleic acid
  modified_base (9)..(9): base is a locked nucleic acid
rgcyatagkwcagtr

SEQ ID NO: 13394 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (12)..(12): base is a locked nucleic acid
rgcyatagkwcagtr

SEQ ID NO: 13395 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (10)..(10): base is a locked nucleic acid
rgcyatagkwcagtr

SEQ ID NO: 13396 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
rgcyatagkwcagtr

SEQ ID NO: 13397 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
rgcyatagkwcagtr

SEQ ID NO: 13398 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
rrgcyatagkwcagt

SEQ ID NO: 13399 - DNA, 15 bp, Artificial Sequence
  Oligonucleotide probe
  misc_binding (1)..(15): Hybridization probe for the specific detection of mutant HIV-1 at codon 73 of the protease gene.
  modified_base (7)..(7): base is a locked nucleic acid
rrgcyatagkwcagt

SEQ ID NO: 13400 - DNA, 15 bp, Artificial Sequence
  Oligonucleotide probe
  misc_binding (1)..(15): Hybridization probe for the specific detection of mutant HIV-1 at codon 73 of the protease gene.
  modified_base (1)..(1): base is a locked nucleic acid
rrgcyatagkwcagt

SEQ ID NO: 13401 - DNA, 15 bp, Artificial Sequence
  Oligonucleotide probe
  misc_binding (1)..(15): Hybridization probe for the specific detection of mutant HIV-1 at codon 73 of the protease gene.
  modified_base (2)..(2): base is a locked nucleic acid
rrgcyatagkwcagt

SEQ ID NO: 13402 - DNA, 15 bp, Artificial Sequence
  Oligonucleotide probe
  misc_binding (1)..(15): Hybridization probe for the specific detection of mutant HIV-1 at codon 73 of the protease gene.
  modified_base (4)..(4): base is a locked nucleic acid
rrgcyatagkwcagt

SEQ ID NO: 13403 - DNA, 15 bp, Artificial Sequence
  Oligonucleotide probe
  misc_binding (1)..(15): Hybridization probe for the specific detection of mutant HIV-1 at codon 73 of the protease gene.
  modified_base (13)..(13): base is a locked nucleic acid
rrgcyatagkwcagt

SEQ ID NO: 13404 - DNA, 15 bp, Artificial Sequence
  Oligonucleotide probe
  misc_binding (1)..(15): Hybridization probe for the specific detection of mutant HIV-1 at codon 73 of the protease gene.
  modified_base (11)..(11): base is a locked nucleic acid
rrgcyatagkwcagt

SEQ ID NO: 13405 - DNA, 15 bp, Artificial Sequence
  Oligonucleotide probe
  misc_binding (1)..(15): Hybridization probe for the specific detection of mutant HIV-1 at codon 73 of the protease gene.
  modified_base (10)..(10): base is a locked nucleic acid
rrgcyatagkwcagt

SEQ ID NO: 13406 - DNA, 16 bp, Artificial Sequence
  Oligonucleotide probe
  misc_binding (1)..(16): Hybridization probe for the specific detection of mutant HIV-1 at codon 73 of the protease gene.
rrgcyatagkwcagtr

SEQ ID NO: 13407 - DNA, 15 bp, Artificial Sequence
  Oligonucleotide probe
  misc_binding (1)..(15): Hybridization probe for the specific detection of mutant HIV-1 at codon 73 of the protease gene.
  modified_base (7)..(7): base is a locked nucleic acid
  modified_base (8)..(8): base is a locked nucleic acid
  modified_base (9)..(9): base is a locked nucleic acid
rrgcyatagkwcagt

SEQ ID NO: 13408 - DNA, 15 bp, Artificial Sequence
  Oligonucleotide probe
  misc_binding (1)..(15): Hybridization probe for the specific detection of mutant HIV-1 at codon 73 of the protease gene.
  modified_base (4)..(4): base is a locked nucleic acid
  modified_base (8)..(8): base is a locked nucleic acid
  modified_base (9)..(9): base is a locked nucleic acid
rrgcyatagkwcagt

SEQ ID NO: 13409 - DNA, 15 bp, Artificial Sequence
  Oligonucleotide probe
  misc_binding (1)..(15): Hybridization probe for the specific detection of mutant HIV-1 at codon 73 of the protease gene.
  modified_base (1)..(1): base is a locked nucleic acid
  modified_base (8)..(8): base is a locked nucleic acid
  modified_base (9)..(9): base is a locked nucleic acid
rrgcyatagkwcagt

SEQ ID NO: 13410 - DNA, 15 bp, Artificial Sequence
  Oligonucleotide probe
  misc_binding (1)..(15): Hybridization probe for the specific detection of mutant HIV-1 at codon 73 of the protease gene.
  modified_base (6)..(6): base is a locked nucleic acid
  modified_base (8)..(8): base is a locked nucleic acid
  modified_base (9)..(9): base is a locked nucleic acid
rrgcyatagkwcagt

SEQ ID NO: 13411 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (13)..(13): base is a locked nucleic acid
rrgcyatagkwcagt

SEQ ID NO: 13412 - DNA, 16 bp, Artificial Sequence
  Oligonucleotide probe
  misc_binding (1)..(16): Hybridization probe for the specific detection of mutant HIV-1 at codon 73 of the protease gene.
  modified_base (8)..(8): base is a locked nucleic acid
  modified_base (9)..(9): base is a locked nucleic acid
rrgcyatagkwcagtr

SEQ ID NO: 13413 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (12)..(12): base is a locked nucleic acid
rrgcyatagkwcagt

SEQ ID NO: 13414 - DNA, 15 bp, Artificial Sequence
  Oligonucleotide probe
  misc_binding (1)..(15): Hybridization probe for the specific detection of mutant HIV-1 at codon 73 of the protease gene.
  modified_base (8)..(8): base is a locked nucleic acid
  modified_base (9)..(9): base is a locked nucleic acid
  modified_base (11)..(11): base is a locked nucleic acid
rrgcyatagkwcagt

SEQ ID NO: 13415 - DNA, 15 bp, Artificial Sequence
  Oligonucleotide probe
  misc_binding (1)..(15): Hybridization probe for the specific detection of mutant HIV-1 at codon 73 of the protease gene.
tactgtrcttatagc

SEQ ID NO: 13416 - DNA, 15 bp, Artificial Sequence
  Oligonucleotide probe
  misc_binding (1)..(15): Hybridization probe for the specific detection of mutant HIV-1 at codon 73 of the protease gene.
  misc_feature (7)..(7): n is a, c, g, or t
tactgtngttatagc

SEQ ID NO: 13417 - DNA, 15 bp, Artificial Sequence
  Oligonucleotide probe
  misc_binding (1)..(15): Hybridization probe for the specific detection of mutant HIV-1 at codon 73 of the protease gene.
tactgtrcatatagc

SEQ ID NO: 13418 - DNA, 15 bp, Artificial Sequence
  Oligonucleotide probe
  misc_binding (1)..(15): Hybridization probe for the specific detection of mutant HIV-1 at codon 73 of the protease gene.
  misc_feature (7)..(7): n is a, c, g, or t
tactgtngctatagc

SEQ ID NO: 13419 - DNA, 19 bp, Artificial Sequence
  Oligonucleotide probe
  misc_binding (1)..(19): Hybridization probe for the specific detection of mutant HIV-1 at codon 73 of the protease gene.
rrgcyatagkwcagtrytr

SEQ ID NO: 13420 - DNA, 19 bp, Artificial Sequence
  Oligonucleotide probe
  misc_binding (1)..(19): Hybridization probe for the specific detection of mutant HIV-1 at codon 73 of the protease gene.
arrgcyatagkwcagtryt

SEQ ID NO: 13421 - DNA, 18 bp, Artificial Sequence
  Oligonucleotide probe
  misc_binding (1)..(18): Hybridization probe for the specific detection of mutant HIV-1 at codon 73 of the protease gene.
rrgcyatagkwcagtryt

SEQ ID NO: 13422 - DNA, 18 bp, Artificial Sequence
  Oligonucleotide probe
  misc_binding (1)..(18): Hybridization probe for the specific detection of mutant HIV-1 at codon 73 of the protease gene.
arrgcyatagkwcagtry

SEQ ID NO: 13423 - DNA, 17 bp, Artificial Sequence
  Oligonucleotide probe
  misc_binding (1)..(17): Hybridization probe for the specific detection of mutant HIV-1 at codon 73 of the protease gene.
rgcyatagkwcagtryt

SEQ ID NO: 13424 - DNA, 17 bp, Artificial Sequence
  Oligonucleotide probe
  misc_binding (1)..(17): Hybridization probe for the specific detection of mutant HIV-1 at codon 73 of the protease gene.
rrgcyatagkwcagtry

SEQ ID NO: 13425 - DNA, 15 bp, Artificial Sequence
  Oligonucleotide probe
  misc_binding (1)..(15): Hybridization probe for the specific detection of mutant HIV-1 at codon 73 of the protease gene.
rgcyatagkwcagtr

SEQ ID NO: 13426 - DNA, 15 bp, Artificial Sequence
  Oligonucleotide probe
  misc_binding (1)..(15): Hybridization probe for the specific detection of mutant HIV-1 at codon 73 of the protease gene.
rrgcyatagkwcagt

SEQ ID NO: 13427 - DNA, 19 bp, Artificial Sequence
  Oligonucleotide probe
  misc_binding (1)..(19): Hybridization probe for the specific detection of mutant HIV-1 at codon 74 of the protease gene.
  modified_base (9)..(9): base is a locked nucleic acid
  modified_base (10)..(10): base is a locked nucleic acid
gcyataggkcagtrytrrt

SEQ ID NO: 13428 - DNA, 19 bp, Artificial Sequence
  Oligonucleotide probe
  misc_binding (1)..(19): Hybridization probe for the specific detection of mutant HIV-1 at codon 74 of the protease gene.
  modified_base (8)..(8): base is a locked nucleic acid
gcyataggkcagtrytrrt

SEQ ID NO: 13429 - DNA, 19 bp, Artificial Sequence
  Oligonucleotide probe
  misc_binding (1)..(19): Hybridization probe for the specific detection of mutant HIV-1 at codon 74 of the protease gene.
  modified_base (4)..(4): base is a locked nucleic acid
gcyataggkcagtrytrrt

SEQ ID NO: 13430 - DNA, 19 bp, Artificial Sequence
  Oligonucleotide probe
  misc_binding (1)..(19): Hybridization probe for the specific detection of mutant HIV-1 at codon 74 of the protease gene.
  modified_base (3)..(3): base is a locked nucleic acid
gcyataggkcagtrytrrt

SEQ ID NO: 13431 - DNA, 19 bp, Artificial Sequence
  Oligonucleotide probe
  misc_binding (1)..(19): Hybridization probe for the specific detection of mutant HIV-1 at codon 74 of the protease gene.
  modified_base (9)..(9): base is a locked nucleic acid
gcyataggkcagtrytrrt

SEQ ID NO: 13432 - DNA, 19 bp, Artificial Sequence
  Oligonucleotide probe
  misc_binding (1)..(19): Hybridization probe for the specific detection of mutant HIV-1 at codon 74 of the protease gene.
  modified_base (12)..(12): base is a locked nucleic acid
gcyataggkcagtrytrrt

SEQ ID NO: 13433 - DNA, 19 bp, Artificial Sequence
  Oligonucleotide probe
  misc_binding (1)..(19): Hybridization probe for the specific detection of mutant HIV-1 at codon 74 of the protease gene.
  modified_base (18)..(18): base is a locked nucleic acid
gcyataggkcagtrytrrt

SEQ ID NO: 13434 - DNA, 19 bp, Artificial Sequence
  Oligonucleotide probe
  misc_binding (1)..(19): Hybridization probe for the specific detection of mutant HIV-1 at codon 74 of the protease gene.
  modified_base (10)..(10): base is a locked nucleic acid
gcyataggkcagtrytrrt

SEQ ID NO: 13435 - DNA, 19 bp, Artificial Sequence
  Oligonucleotide probe
  misc_binding (1)..(19): Hybridization probe for the specific detection of mutant HIV-1 at codon 74 of the protease gene.
  modified_base (17)..(17): base is a locked nucleic acid
gcyataggkcagtrytrrt

SEQ ID NO: 13436 - DNA, 19 bp, Artificial Sequence
  Oligonucleotide probe
  misc_binding (1)..(19): Hybridization probe for the specific detection of mutant HIV-1 at codon 74 of the protease gene.
  modified_base (3)..(3): base is a locked nucleic acid
  modified_base (9)..(9): base is a locked nucleic acid
  modified_base (10)..(10): base is a locked nucleic acid
gcyataggkcagtrytrrt

SEQ ID NO: 13437 - DNA, 19 bp, Artificial Sequence
  Oligonucleotide probe
  misc_binding (1)..(19): Hybridization probe for the specific detection of mutant HIV-1 at codon 74 of the protease gene.
  modified_base (7)..(7): base is a locked nucleic acid
  modified_base (9)..(9): base is a locked nucleic acid
  modified_base (10)..(10): base is a locked nucleic acid
gcyataggkcagtrytrrt

SEQ ID NO: 13438 - DNA, 19 bp, Artificial Sequence
  Oligonucleotide probe
  misc_binding (1)..(19): Hybridization probe for the specific detection of mutant HIV-1 at codon 74 of the protease gene.
  modified_base (4)..(4): base is a locked nucleic acid
  modified_base (9)..(9): base is a locked nucleic acid
  modified_base (10)..(10): base is a locked nucleic acid
gcyataggkcagtrytrrt

SEQ ID NO: 13439 - DNA, 19 bp, Artificial Sequence
  Oligonucleotide probe
  misc_binding (1)..(19): Hybridization probe for the specific detection of mutant HIV-1 at codon 74 of the protease gene.
  modified_base (5)..(5): base is a locked nucleic acid
  modified_base (9)..(9): base is a locked nucleic acid
  modified_base (10)..(10): base is a locked nucleic acid
gcyataggkcagtrytrrt

SEQ ID NO: 13440 - DNA, 19 bp, Artificial Sequence
  Oligonucleotide probe
  misc_binding (1)..(19): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (18)..(18): base is a locked nucleic acid
gcyataggkcagtrytrrt

SEQ ID NO: 13441 - DNA, 19 bp, Artificial Sequence
  Oligonucleotide probe
  misc_binding (1)..(19): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (13)..(13): base is a locked nucleic acid
gcyataggkcagtrytrrt

SEQ ID NO: 13442 - DNA, 19 bp, Artificial Sequence
  Oligonucleotide probe
  misc_binding (1)..(19): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (14)..(14): base is a locked nucleic acid
gcyataggkcagtrytrrt

SEQ ID NO: 13443 - DNA, 19 bp, Artificial Sequence
  Oligonucleotide probe
  misc_binding (1)..(19): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (11)..(11): base is a locked nucleic acid
gcyataggkcagtrytrrt

SEQ ID NO: 13444 - DNA, 18 bp, Artificial Sequence
  Oligonucleotide probe
  misc_binding (1)..(18): Hybridization probe for the specific detection of mutant HIV-1 at codon 74 of the protease gene.
  modified_base (9)..(9): base is a locked nucleic acid
  modified_base (10)..(10): base is a locked nucleic acid
gcyataggkcagtrytrr

SEQ ID NO: 13445 - DNA, 18 bp, Artificial Sequence
  Oligonucleotide probe
  misc_binding (1)..(18): Hybridization probe for the specific detection of mutant HIV-1 at codon 74 of the protease gene.
  modified_base (8)..(8): base is a locked nucleic acid
gcyataggkcagtrytrr

SEQ ID NO: 13446 - DNA, 18 bp, Artificial Sequence
  Oligonucleotide probe
  misc_binding (1)..(18): Hybridization probe for the specific detection of mutant HIV-1 at codon 74 of the protease gene.
  modified_base (4)..(4): base is a locked nucleic acid
gcyataggkcagtrytrr

SEQ ID NO: 13447 - DNA, 18 bp, Artificial Sequence
  Oligonucleotide probe
  misc_binding (1)..(18): Hybridization probe for the specific detection of mutant HIV-1 at codon 74 of the protease gene.
  modified_base (3)..(3): base is a locked nucleic acid
gcyataggkcagtrytrr

SEQ ID NO: 13448 - DNA, 18 bp, Artificial Sequence
  Oligonucleotide probe
  misc_binding (1)..(18): Hybridization probe for the specific detection of mutant HIV-1 at codon 74 of the protease gene.
  modified_base (9)..(9): base is a locked nucleic acid
gcyataggkcagtrytrr

SEQ ID NO: 13449 - DNA, 18 bp, Artificial Sequence
  Oligonucleotide probe
  misc_binding (1)..(18): Hybridization probe for the specific detection of mutant HIV-1 at codon 74 of the protease gene.
  modified_base (12)..(12): base is a locked nucleic acid
gcyataggkcagtrytrr

SEQ ID NO: 13450 - DNA, 18 bp, Artificial Sequence
  Oligonucleotide probe
  misc_binding (1)..(18): Hybridization probe for the specific detection of mutant HIV-1 at codon 74 of the protease gene.
  modified_base (18)..(18): base is a locked nucleic acid
gcyataggkcagtrytrr

SEQ ID NO: 13451 - DNA, 18 bp, Artificial Sequence
  Oligonucleotide probe
  misc_binding (1)..(18): Hybridization probe for the specific detection of mutant HIV-1 at codon 74 of the protease gene.
  modified_base (10)..(10): base is a locked nucleic acid
gcyataggkcagtrytrr

SEQ ID NO: 13452 - DNA, 18 bp, Artificial Sequence
  Oligonucleotide probe
  misc_binding (1)..(18): Hybridization probe for the specific detection of mutant HIV-1 at codon 74 of the protease gene.
  modified_base (17)..(17): base is a locked nucleic acid
gcyataggkcagtrytrr

SEQ ID NO: 13453 - DNA, 18 bp, Artificial Sequence
  Oligonucleotide probe
  misc_binding (1)..(18): Hybridization probe for the specific detection of mutant HIV-1 at codon 74 of the protease gene.
  modified_base (3)..(3): base is a locked nucleic acid
  modified_base (9)..(9): base is a locked nucleic acid
  modified_base (10)..(10): base is a locked nucleic acid
gcyataggkcagtrytrr

SEQ ID NO: 13454 - DNA, 18 bp, Artificial Sequence
  Oligonucleotide probe
  misc_binding (1)..(18): Hybridization probe for the specific detection of mutant HIV-1 at codon 74 of the protease gene.
  modified_base (7)..(7): base is a locked nucleic acid
  modified_base (9)..(9): base is a locked nucleic acid
  modified_base (10)..(10): base is a locked nucleic acid
gcyataggkcagtrytrr

SEQ ID NO: 13455 - DNA, 18 bp, Artificial Sequence
  Oligonucleotide probe
  misc_binding (1)..(18): Hybridization probe for the specific detection of mutant HIV-1 at codon 74 of the protease gene.
  modified_base (4)..(4): base is a locked nucleic acid
  modified_base (9)..(9): base is a locked nucleic acid
  modified_base (10)..(10): base is a locked nucleic acid
gcyataggkcagtrytrr

SEQ ID NO: 13456 - DNA, 18 bp, Artificial Sequence
  Oligonucleotide probe
  misc_binding (1)..(18): Hybridization probe for the specific detection of mutant HIV-1 at codon 74 of the protease gene.
  modified_base (5)..(5): base is a locked nucleic acid
  modified_base (9)..(9): base is a locked nucleic acid
  modified_base (10)..(10): base is a locked nucleic acid
gcyataggkcagtrytrr

SEQ ID NO: 13457 - DNA, 18 bp, Artificial Sequence
  Oligonucleotide probe
  misc_binding (1)..(18): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (18)..(18): base is a locked nucleic acid
gcyataggkcagtrytrr

SEQ ID NO: 13458 - DNA, 18 bp, Artificial Sequence
  Oligonucleotide probe
  misc_binding (1)..(18): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (13)..(13): base is a locked nucleic acid
gcyataggkcagtrytrr

SEQ ID NO: 13459 - DNA, 18 bp, Artificial Sequence
  Oligonucleotide probe
  misc_binding (1)..(18): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (14)..(14): base is a locked nucleic acid
gcyataggkcagtrytrr

SEQ ID NO: 13460 - DNA, 18 bp, Artificial Sequence
  Oligonucleotide probe
  misc_binding (1)..(18): Hybridization probe for the specific detection of mutant HIV-1 at codon 74 of the protease gene.
  modified_base (9)..(9): base is a locked nucleic acid
  modified_base (10)..(10): base is a locked nucleic acid
  modified_base (11)..(11): base is a locked nucleic acid
gcyataggkcagtrytrr

SEQ ID NO: 13461 - DNA, 17 bp, Artificial Sequence
  Oligonucleotide probe
  misc_binding (1)..(17): Hybridization probe for the specific detection of mutant HIV-1 at codon 74 of the protease gene.
  modified_base (8)..(8): base is a locked nucleic acid
  modified_base (9)..(9): base is a locked nucleic acid
cyataggkcagtrytrr

SEQ ID NO: 13462 - DNA, 17 bp, Artificial Sequence
  Oligonucleotide probe
  misc_binding (1)..(17): Hybridization probe for the specific detection of mutant HIV-1 at codon 74 of the protease gene.
  modified_base (7)..(7): base is a locked nucleic acid
cyataggkcagtrytrr

SEQ ID NO: 13463 - DNA, 17 bp, Artificial Sequence
  Oligonucleotide probe
  misc_binding (1)..(17): Hybridization probe for the specific detection of mutant HIV-1 at codon 74 of the protease gene.
  modified_base (3)..(3): base is a locked nucleic acid
cyataggkcagtrytrr

SEQ ID NO: 13464 - DNA, 17 bp, Artificial Sequence
  Oligonucleotide probe
  misc_binding (1)..(17): Hybridization probe for the specific detection of mutant HIV-1 at codon 74 of the protease gene.
  modified_base (2)..(2): base is a locked nucleic acid
cyataggkcagtrytrr

SEQ ID NO: 13465 - DNA, 17 bp, Artificial Sequence
  Oligonucleotide probe
  misc_binding (1)..(17): Hybridization probe for the specific detection of mutant HIV-1 at codon 74 of the protease gene.
  modified_base (8)..(8): base is a locked nucleic acid
cyataggkcagtrytrr

SEQ ID NO: 13466 - DNA, 17 bp, Artificial Sequence
  Oligonucleotide probe
  misc_binding (1)..(17): Hybridization probe for the specific detection of mutant HIV-1 at codon 74 of the protease gene.
  modified_base (11)..(11): base is a locked nucleic acid
cyataggkcagtrytrr

SEQ ID NO: 13467 - DNA, 17 bp, Artificial Sequence
  Oligonucleotide probe
  misc_binding (1)..(17): Hybridization probe for the specific detection of mutant HIV-1 at codon 74 of the protease gene.
  modified_base (17)..(17): base is a locked nucleic acid
cyataggkcagtrytrr

SEQ ID NO: 13468 - DNA, 17 bp, Artificial Sequence
  Oligonucleotide probe
  misc_binding (1)..(17): Hybridization probe for the specific detection of mutant HIV-1 at codon 74 of the protease gene.
  modified_base (9)..(9): base is a locked nucleic acid
cyataggkcagtrytrr

SEQ ID NO: 13469 - DNA, 17 bp, Artificial Sequence
  Oligonucleotide probe
  misc_binding (1)..(17): Hybridization probe for the specific detection of mutant HIV-1 at codon 74 of the protease gene.
  modified_base (16)..(16): base is a locked nucleic acid
cyataggkcagtrytrr

SEQ ID NO: 13470 - DNA, 17 bp, Artificial Sequence
  Oligonucleotide probe
  misc_binding (1)..(17): Hybridization probe for the specific detection of mutant HIV-1 at codon 74 of the protease gene.
  modified_base (2)..(2): base is a locked nucleic acid
  modified_base (8)..(8): base is a locked nucleic acid
  modified_base (9)..(9): base is a locked nucleic acid
cyataggkcagtrytrr

SEQ ID NO: 13471 - DNA, 17 bp, Artificial Sequence
  Oligonucleotide probe
  misc_binding (1)..(17): Hybridization probe for the specific detection of mutant HIV-1 at codon 74 of the protease gene.
  modified_base (6)..(6): base is a locked nucleic acid
  modified_base (8)..(8): base is a locked nucleic acid
  modified_base (9)..(9): base is a locked nucleic acid
cyataggkcagtrytrr

SEQ ID NO: 13472 - DNA, 17 bp, Artificial Sequence
  Oligonucleotide probe
  misc_binding (1)..(17): Hybridization probe for the specific detection of mutant HIV-1 at codon 74 of the protease gene.
  modified_base (3)..(3): base is a locked nucleic acid
  modified_base (8)..(8): base is a locked nucleic acid
  modified_base (9)..(9): base is a locked nucleic acid
cyataggkcagtrytrr

SEQ ID NO: 13473 - DNA, 17 bp, Artificial Sequence
  Oligonucleotide probe
  misc_binding (1)..(17): Hybridization probe for the specific detection of mutant HIV-1 at codon 74 of the protease gene.
  modified_base (4)..(4): base is a locked nucleic acid
  modified_base (8)..(8): base is a locked nucleic acid
  modified_base (9)..(9): base is a locked nucleic acid
cyataggkcagtrytrr

SEQ ID NO: 13474 - DNA, 17 bp, Artificial Sequence
  Oligonucleotide probe
  misc_binding (1)..(17): Hybridization probe for the specific detection of mutant HIV-1 at codon 74 of the protease gene.
  modified_base (8)..(8): base is a locked nucleic acid
  modified_base (9)..(9): base is a locked nucleic acid
  modified_base (17)..(17): base is a locked nucleic acid
cyataggkcagtrytrr

SEQ ID NO: 13475 - DNA, 17 bp, Artificial Sequence
  Oligonucleotide probe
  misc_binding (1)..(17): Hybridization probe for the specific detection of mutant HIV-1 at codon 74 of the protease gene.
  modified_base (8)..(8): base is a locked nucleic acid
  modified_base (9)..(9): base is a locked nucleic acid
  modified_base (12)..(12): base is a locked nucleic acid
cyataggkcagtrytrr

SEQ ID NO: 13476 - DNA, 17 bp, Artificial Sequence
  Oligonucleotide probe
  misc_binding (1)..(17): Hybridization probe for the specific detection of mutant HIV-1 at codon 74 of the protease gene.
  modified_base (8)..(8): base is a locked nucleic acid
  modified_base (9)..(9): base is a locked nucleic acid
  modified_base (13)..(13): base is a locked nucleic acid
cyataggkcagtrytrr

SEQ ID NO: 13477 - DNA, 17 bp, Artificial Sequence
  Oligonucleotide probe
  misc_binding (1)..(17): Hybridization probe for the specific detection of mutant HIV-1 at codon 74 of the protease gene.
  modified_base (8)..(8): base is a locked nucleic acid
  modified_base (9)..(9): base is a locked nucleic acid
  modified_base (10)..(10): base is a locked nucleic acid
cyataggkcagtrytrr

SEQ ID NO: 13478 - DNA, 15 bp, Artificial Sequence
  Oligonucleotide probe
  misc_binding (1)..(15): Hybridization probe for the specific detection of mutant HIV-1 at codon 74 of the protease gene.
  modified_base (8)..(8): base is a locked nucleic acid
  modified_base (9)..(9): base is a locked nucleic acid
cyataggkcagtryt

SEQ ID NO: 13479 - DNA, 15 bp, Artificial Sequence
  Oligonucleotide probe
  misc_binding (1)..(15): Hybridization probe for the specific detection of mutant HIV-1 at codon 74 of the protease gene.
  modified_base (7)..(7): base is a locked nucleic acid
cyataggkcagtryt

SEQ ID NO: 13480 - DNA, 15 bp, Artificial Sequence
  Oligonucleotide probe
  misc_binding (1)..(15): Hybridization probe for the specific detection of mutant HIV-1 at codon 74 of the protease gene.
  modified_base (3)..(3): base is a locked nucleic acid
cyataggkcagtryt

SEQ ID NO: 13481 - DNA, 15 bp, Artificial Sequence
  Oligonucleotide probe
  misc_binding (1)..(15): Hybridization probe for the specific detection of mutant HIV-1 at codon 74 of the protease gene.
  modified_base (2)..(2): base is a locked nucleic acid
cyataggkcagtryt

SEQ ID NO: 13482 - DNA, 15 bp, Artificial Sequence
  Oligonucleotide probe
  misc_binding (1)..(15): Hybridization probe for the specific detection of mutant HIV-1 at codon 74 of the protease gene.
  modified_base (8)..(8): base is a locked nucleic acid
cyataggkcagtryt

SEQ ID NO: 13483 - DNA, 15 bp, Artificial Sequence
  Oligonucleotide probe
  misc_binding (1)..(15): Hybridization probe for the specific detection of mutant HIV-1 at codon 74 of the protease gene.
  modified_base (11)..(11): base is a locked nucleic acid
cyataggkcagtryt

SEQ ID NO: 13484 - DNA, 16 bp, Artificial Sequence
  Oligonucleotide probe
  misc_binding (1)..(16): Hybridization probe for the specific detection of mutant HIV-1 at codon 74 of the protease gene.
cyataggkcagtrytr

SEQ ID NO: 13485 - DNA, 15 bp, Artificial Sequence
  Oligonucleotide probe
  misc_binding (1)..(15): Hybridization probe for the specific detection of mutant HIV-1 at codon 74 of the protease gene.
  modified_base (9)..(9): base is a locked nucleic acid
cyataggkcagtryt

SEQ ID NO: 13486 - DNA, 15 bp, Artificial Sequence
  Oligonucleotide probe
  misc_binding (1)..(15): Hybridization probe for the specific detection of mutant HIV-1 at codon 74 of the protease gene.
cyataggkcagtryt

SEQ ID NO: 13487 - DNA, 15 bp, Artificial Sequence
  Oligonucleotide probe
  misc_binding (1)..(15): Hybridization probe for the specific detection of mutant HIV-1 at codon 74 of the protease gene.
  modified_base (2)..(2): base is a locked nucleic acid
  modified_base (8)..(8): base is a locked nucleic acid
  modified_base (9)..(9): base is a locked nucleic acid
cyataggkcagtryt

SEQ ID NO: 13488 - DNA, 15 bp, Artificial Sequence
  Oligonucleotide probe
  misc_binding (1)..(15): Hybridization probe for the specific detection of mutant HIV-1 at codon 74 of the protease gene.
  modified_base (6)..(6): base is a locked nucleic acid
  modified_base (8)..(8): base is a locked nucleic acid
  modified_base (9)..(9): base is a locked nucleic acid
cyataggkcagtryt

SEQ ID NO: 13489 - DNA, 15 bp, Artificial Sequence
  Oligonucleotide probe
  misc_binding (1)..(15): Hybridization probe for the specific detection of mutant HIV-1 at codon 74 of the protease gene.
  modified_base (3)..(3): base is a locked nucleic acid
  modified_base (8)..(8): base is a locked nucleic acid
  modified_base (9)..(9): base is a locked nucleic acid
cyataggkcagtryt

SEQ ID NO: 13490 - DNA, 15 bp, Artificial Sequence
  Oligonucleotide probe
  misc_binding (1)..(15): Hybridization probe for the specific detection of mutant HIV-1 at codon 74 of the protease gene.
  modified_base (4)..(4): base is a locked nucleic acid
  modified_base (8)..(8): base is a locked nucleic acid
  modified_base (9)..(9): base is a locked nucleic acid
cyataggkcagtryt

SEQ ID NO: 13491 - DNA, 16 bp, Artificial Sequence
  Oligonucleotide probe
  misc_binding (1)..(16): Hybridization probe for the specific detection of mutant HIV-1 at codon 74 of the protease gene.
  modified_base (8)..(8): base is a locked nucleic acid
  modified_base (9)..(9): base is a locked nucleic acid
cyataggkcagtrytr

SEQ ID NO: 13492 - DNA, 15 bp, Artificial Sequence
  Oligonucleotide probe
  misc_binding (1)..(15): Hybridization probe for the specific detection of mutant HIV-1 at codon 74 of the protease gene.
  modified_base (8)..(8): base is a locked nucleic acid
  modified_base (9)..(9): base is a locked nucleic acid
  modified_base (12)..(12): base is a locked nucleic acid
cyataggkcagtryt

SEQ ID NO: 13493 - DNA, 15 bp, Artificial Sequence
  Oligonucleotide probe
  misc_binding (1)..(15): Hybridization probe for the specific detection of mutant HIV-1 at codon 74 of the protease gene.
  modified_base (8)..(8): base is a locked nucleic acid
  modified_base (9)..(9): base is a locked nucleic acid
  modified_base (13)..(13): base is a locked nucleic acid
cyataggkcagtryt

SEQ ID NO: 13494 - DNA, 15 bp, Artificial Sequence
  Oligonucleotide probe
  misc_binding (1)..(15): Hybridization probe for the specific detection of mutant HIV-1 at codon 74 of the protease gene.
  modified_base (8)..(8): base is a locked nucleic acid
  modified_base (9)..(9): base is a locked nucleic acid
  modified_base (10)..(10): base is a locked nucleic acid
cyataggkcagtryt

SEQ ID NO: 13495 - DNA, 15 bp, Artificial Sequence
  Oligonucleotide probe
  misc_binding (1)..(15): Hybridization probe for the specific detection of mutant HIV-1 at codon 74 of the protease gene.
ataggtccrgtatta

SEQ ID NO: 13496 - DNA, 19 bp, Artificial Sequence
  Oligonucleotide probe
  misc_binding (1)..(19): Hybridization probe for the specific detection of mutant HIV-1 at codon 74 of the protease gene.
gcyataggkcagtrytrrt

SEQ ID NO: 13497 - DNA, 18 bp, Artificial Sequence
  Oligonucleotide probe
  misc_binding (1)..(18): Hybridization probe for the specific detection of mutant HIV-1 at codon 74 of the protease gene.
gcyataggkcagtrytrr

SEQ ID NO: 13498 - DNA, 17 bp, Artificial Sequence
  Oligonucleotide probe
  misc_binding (1)..(17): Hybridization probe for the specific detection of mutant HIV-1 at codon 74 of the protease gene.
cyataggkcagtrytrr

SEQ ID NO: 13499 - DNA, 15 bp, Artificial Sequence
  Oligonucleotide probe
  misc_binding (1)..(15): Hybridization probe for the specific detection of mutant HIV-1 at codon 74 of the protease gene.
cyataggkcagtryt

SEQ ID NO: 13500 - DNA, 19 bp, Artificial Sequence
  Oligonucleotide probe
  misc_binding (1)..(19): Hybridization probe for the specific detection of mutant HIV-1 at codon 76 of the protease gene.
  modified_base (9)..(9): base is a locked nucleic acid
  modified_base (10)..(10): base is a locked nucleic acid
ggkwcagtrtrrtrggrcc

SEQ ID NO: 13501 - DNA, 19 bp, Artificial Sequence
  Oligonucleotide probe
  misc_binding (1)..(19): Hybridization probe for the specific detection of mutant HIV-1 at codon 76 of the protease gene.
  modified_base (7)..(7): base is a locked nucleic acid
ggkwcagtrtrrtrggrcc

SEQ ID NO: 13502 - DNA, 19 bp, Artificial Sequence
  Oligonucleotide probe
  misc_binding (1)..(19): Hybridization probe for the specific detection of mutant HIV-1 at codon 76 of the protease gene.
  modified_base (4)..(4): base is a locked nucleic acid
ggkwcagtrtrrtrggrcc

SEQ ID NO: 13503 - DNA, 19 bp, Artificial Sequence
  Oligonucleotide probe
  misc_binding (1)..(19): Hybridization probe for the specific detection of mutant HIV-1 at codon 76 of the protease gene.
  modified_base (9)..(9): base is a locked nucleic acid
ggkwcagtrtrrtrggrcc

SEQ ID NO: 13504 - DNA, 19 bp, Artificial Sequence
  Oligonucleotide probe
  misc_binding (1)..(19): Hybridization probe for the specific detection of mutant HIV-1 at codon 76 of the protease gene.
  modified_base (2)..(2): base is a locked nucleic acid
ggkwcagtrtrrtrggrcc

SEQ ID NO: 13505 - DNA, 19 bp, Artificial Sequence
  Oligonucleotide probe
  misc_binding (1)..(19): Hybridization probe for the specific detection of mutant HIV-1 at codon 76 of the protease gene.
  modified_base (18)..(18): base is a locked nucleic acid
ggkwcagtrtrrtrggrcc

SEQ ID NO: 13506 - DNA, 19 bp, Artificial Sequence
  Oligonucleotide probe
  misc_binding (1)..(19): Hybridization probe for the specific detection of mutant HIV-1 at codon 76 of the protease gene.
  modified_base (14)..(14): base is a locked nucleic acid
ggkwcagtrtrrtrggrcc

SEQ ID NO: 13507 - DNA, 19 bp, Artificial Sequence
  Oligonucleotide probe
  misc_binding (1)..(19): Hybridization probe for the specific detection of mutant HIV-1 at codon 76 of the protease gene.
  modified_base (12)..(12): base is a locked nucleic acid
ggkwcagtrtrrtrggrcc

SEQ ID NO: 13508 - DNA, 19 bp, Artificial Sequence
  Oligonucleotide probe
  misc_binding (1)..(19): Hybridization probe for the specific detection of mutant HIV-1 at codon 76 of the protease gene.
  modified_base (10)..(10): base is a locked nucleic acid
ggkwcagtrtrrtrggrcc

SEQ ID NO: 13509 - DNA, 19 bp, Artificial Sequence
  Oligonucleotide probe
  misc_binding (1)..(19): Hybridization probe for the specific detection of mutant HIV-1 at codon 76 of the protease gene.
  modified_base (5)..(5): base is a locked nucleic acid
  modified_base (9)..(9): base is a locked nucleic acid
  modified_base (10)..(10): base is a locked nucleic acid
ggkwcagtrtrrtrggrcc

SEQ ID NO: 13510 - DNA, 19 bp, Artificial Sequence
  Oligonucleotide probe
  misc_binding (1)..(19): Hybridization probe for the specific detection of mutant HIV-1 at codon 76 of the protease gene.
  modified_base (3)..(3): base is a locked nucleic acid
  modified_base (9)..(9): base is a locked nucleic acid
  modified_base (10)..(10): base is a locked nucleic acid
ggkwcagtrtrrtrggrcc

SEQ ID NO: 13511 - DNA, 19 bp, Artificial Sequence
  Oligonucleotide probe
  misc_binding (1)..(19): Hybridization probe for the specific detection of mutant HIV-1 at codon 76 of the protease gene.
  modified_base (6)..(6): base is a locked nucleic acid
  modified_base (9)..(9): base is a locked nucleic acid
  modified_base (10)..(10): base is a locked nucleic acid
ggkwcagtrtrrtrggrcc

SEQ ID NO: 13512 - DNA, 19 bp, Artificial Sequence
  Oligonucleotide probe
  misc_binding (1)..(19): Hybridization probe for the specific detection of mutant HIV-1 at codon 76 of the protease gene.
  modified_base (2)..(2): base is a locked nucleic acid
  modified_base (9)..(9): base is a locked nucleic acid
  modified_base (10)..(10): base is a locked nucleic acid
ggkwcagtrtrrtrggrcc

SEQ ID NO: 13513 - DNA, 19 bp, Artificial Sequence
  Oligonucleotide probe
  misc_binding (1)..(19): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (11)..(11): base is a locked nucleic acid
ggkwcagtrtrrtrggrcc

SEQ ID NO: 13514 - DNA, 19 bp, Artificial Sequence
  Oligonucleotide probe
  misc_binding (1)..(19): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (13)..(13): base is a locked nucleic acid
ggkwcagtrtrrtrggrcc

SEQ ID NO: 13515 - DNA, 19 bp, Artificial Sequence
  Oligonucleotide probe
  misc_binding (1)..(19): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (14)..(14): base is a locked nucleic acid
ggkwcagtrtrrtrggrcc

SEQ ID NO: 13516 - DNA, 19 bp, Artificial Sequence
  Oligonucleotide probe
  misc_binding (1)..(19): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (15)..(15): base is a locked nucleic acid
ggkwcagtrtrrtrggrcc

SEQ ID NO: 13517 - DNA, 18 bp, Artificial Sequence
  Oligonucleotide probe
  misc_binding (1)..(18): Hybridization probe for the specific detection of mutant HIV-1 at codon 76 of the protease gene.
  modified_base (9)..(9): base is a locked nucleic acid
  modified_base (10)..(10): base is a locked nucleic acid
ggkwcagtrtrrtrggrc

SEQ ID NO: 13518 - DNA, 18 bp, Artificial Sequence
  Oligonucleotide probe
  misc_binding (1)..(18): Hybridization probe for the specific detection of mutant HIV-1 at codon 76 of the protease gene.
  modified_base (7)..(7): base is a locked nucleic acid
ggkwcagtrtrrtrggrc

SEQ ID NO: 13519 - DNA, 18 bp, Artificial Sequence
  Oligonucleotide probe
  misc_binding (1)..(18): Hybridization probe for the specific detection of mutant HIV-1 at codon 76 of the protease gene.
  modified_base (4)..(4): base is a locked nucleic acid
ggkwcagtrtrrtrggrc

SEQ ID NO: 13520 - DNA, 18 bp, Artificial Sequence
  Oligonucleotide probe
  misc_binding (1)..(18): Hybridization probe for the specific detection of mutant HIV-1 at codon 76 of the protease gene.
  modified_base (9)..(9): base is a locked nucleic acid
ggkwcagtrtrrtrggrc

SEQ ID NO: 13521 - DNA, 18 bp, Artificial Sequence
  Oligonucleotide probe
  misc_binding (1)..(18): Hybridization probe for the specific detection of mutant HIV-1 at codon 76 of the protease gene.
  modified_base (2)..(2): base is a locked nucleic acid
ggkwcagtrtrrtrggrc

SEQ ID NO: 13522 - DNA, 18 bp, Artificial Sequence
  Oligonucleotide probe
  misc_binding (1)..(18): Hybridization probe for the specific detection of mutant HIV-1 at codon 76 of the protease gene.
  modified_base (18)..(18): base is a locked nucleic acid
ggkwcagtrtrrtrggrc

SEQ ID NO: 13523 - DNA, 18 bp, Artificial Sequence
  Oligonucleotide probe
  misc_binding (1)..(18): Hybridization probe for the specific detection of mutant HIV-1 at codon 76 of the protease gene.
  modified_base (14)..(14): base is a locked nucleic acid
ggkwcagtrtrrtrggrc

SEQ ID NO: 13524 - DNA, 18 bp, Artificial Sequence
  Oligonucleotide probe
  misc_binding (1)..(18): Hybridization probe for the specific detection of mutant HIV-1 at codon 76 of the protease gene.
  modified_base (12)..(12): base is a locked nucleic acid
ggkwcagtrtrrtrggrc

SEQ ID NO: 13525 - DNA, 18 bp, Artificial Sequence
  Oligonucleotide probe
  misc_binding (1)..(18): Hybridization probe for the specific detection of mutant HIV-1 at codon 76 of the protease gene.
  modified_base (10)..(10): base is a locked nucleic acid
ggkwcagtrtrrtrggrc

SEQ ID NO: 13526 - DNA, 18 bp, Artificial Sequence
  Oligonucleotide probe
  misc_binding (1)..(18): Hybridization probe for the specific detection of mutant HIV-1 at codon 76 of the protease gene.
  modified_base (5)..(5): base is a locked nucleic acid
  modified_base (9)..(9): base is a locked nucleic acid
  modified_base (10)..(10): base is a locked nucleic acid
ggkwcagtrtrrtrggrc

SEQ ID NO: 13527 - DNA, 18 bp, Artificial Sequence
  Oligonucleotide probe
  misc_binding (1)..(18): Hybridization probe for the specific detection of mutant HIV-1 at codon 76 of the protease gene.
  modified_base (3)..(3): base is a locked nucleic acid
  modified_base (9)..(9): base is a locked nucleic acid
  modified_base (10)..(10): base is a locked nucleic acid
ggkwcagtrtrrtrggrc

SEQ ID NO: 13528 - DNA, 18 bp, Artificial Sequence
  Oligonucleotide probe
  misc_binding (1)..(18): Hybridization probe for the specific detection of mutant HIV-1 at codon 76 of the protease gene.
  modified_base (6)..(6): base is a locked nucleic acid
  modified_base (9)..(9): base is a locked nucleic acid
  modified_base (10)..(10): base is a locked nucleic acid
ggkwcagtrtrrtrggrc

SEQ ID NO: 13529 - DNA, 18 bp, Artificial Sequence
  Oligonucleotide probe
  misc_binding (1)..(18): Hybridization probe for the specific detection of mutant HIV-1 at codon 76 of the protease gene.
  modified_base (2)..(2): base is a locked nucleic acid
  modified_base (9)..(9): base is a locked nucleic acid
  modified_base (10)..(10): base is a locked nucleic acid
ggkwcagtrtrrtrggrc

SEQ ID NO: 13530 - DNA, 18 bp, Artificial Sequence
  Oligonucleotide probe
  misc_binding (1)..(18): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (11)..(11): base is a locked nucleic acid
ggkwcagtrtrrtrggrc

SEQ ID NO: 13531 - DNA, 18 bp, Artificial Sequence
  Oligonucleotide probe
  misc_binding (1)..(18): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (13)..(13): base is a locked nucleic acid
ggkwcagtrtrrtrggrc

SEQ ID NO: 13532 - DNA, 18 bp, Artificial Sequence
  Oligonucleotide probe
  misc_binding (1)..(18): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (14)..(14): base is a locked nucleic acid
ggkwcagtrtrrtrggrc

SEQ ID NO: 13533 - DNA, 18 bp, Artificial Sequence
  Oligonucleotide probe
  misc_binding (1)..(18): Hybridization probe for the specific detection of mutant HIV-1 at codon 76 of the protease gene.
  modified_base (9)..(9): base is a locked nucleic acid
  modified_base (10)..(10): base is a locked nucleic acid
  modified_base (15)..(15): base is a locked nucleic acid
ggkwcagtrtrrtrggrc

SEQ ID NO: 13534 - DNA, 17 bp, Artificial Sequence
  Oligonucleotide probe
  misc_binding (1)..(17): Hybridization probe for the specific detection of mutant HIV-1 at codon 76 of the protease gene.
  modified_base (8)..(8): base is a locked nucleic acid
  modified_base (9)..(9): base is a locked nucleic acid
gkwcagtrtrrtrggrc

SEQ ID NO: 13535 - DNA, 17 bp, Artificial Sequence
  Oligonucleotide probe
  misc_binding (1)..(17): Hybridization probe for the specific detection of mutant HIV-1 at codon 76 of the protease gene.
  modified_base (6)..(6): base is a locked nucleic acid
gkwcagtrtrrtrggrc

SEQ ID NO: 13536 - DNA, 17 bp, Artificial Sequence
  Oligonucleotide probe
  misc_binding (1)..(17): Hybridization probe for the specific detection of mutant HIV-1 at codon 76 of the protease gene.
  modified_base (3)..(3): base is a locked nucleic acid
gkwcagtrtrrtrggrc

SEQ ID NO: 13537 - DNA, 17 bp, Artificial Sequence
  Oligonucleotide probe
  misc_binding (1)..(17): Hybridization probe for the specific detection of mutant HIV-1 at codon 76 of the protease gene.
  modified_base (8)..(8): base is a locked nucleic acid
gkwcagtrtrrtrggrc

SEQ ID NO: 13538 - DNA, 17 bp, Artificial Sequence
  Oligonucleotide probe
  misc_binding (1)..(17): Hybridization probe for the specific detection of mutant HIV-1 at codon 76 of the protease gene.
  modified_base (1)..(1): base is a locked nucleic acid
gkwcagtrtrrtrggrc

SEQ ID NO: 13539 - DNA, 17 bp, Artificial Sequence
  Oligonucleotide probe
  misc_binding (1)..(17): Hybridization probe for the specific detection of mutant HIV-1 at codon 76 of the protease gene.
  modified_base (17)..(17): base is a locked nucleic acid
gkwcagtrtrrtrggrc

SEQ ID NO: 13540 - DNA, 17 bp, Artificial Sequence
  Oligonucleotide probe
  misc_binding (1)..(17): Hybridization probe for the specific detection of mutant HIV-1 at codon 76 of the protease gene.
  modified_base (13)..(13): base is a locked nucleic acid
gkwcagtrtrrtrggrc

SEQ ID NO: 13541 - DNA, 17 bp, Artificial Sequence
  Oligonucleotide probe
  misc_binding (1)..(17): Hybridization probe for the specific detection of mutant HIV-1 at codon 76 of the protease gene.
  modified_base (11)..(11): base is a locked nucleic acid
gkwcagtrtrrtrggrc

SEQ ID NO: 13542 - DNA, 17 bp, Artificial Sequence
  Oligonucleotide probe
  misc_binding (1)..(17): Hybridization probe for the specific detection of mutant HIV-1 at codon 76 of the protease gene.
  modified_base (9)..(9): base is a locked nucleic acid
gkwcagtrtrrtrggrc

SEQ ID NO: 13543 - DNA, 17 bp, Artificial Sequence
  Oligonucleotide probe
  misc_binding (1)..(17): Hybridization probe for the specific detection of mutant HIV-1 at codon 76 of the protease gene.
  modified_base (4)..(4): base is a locked nucleic acid
  modified_base (8)..(8): base is a locked nucleic acid
  modified_base (9)..(9): base is a locked nucleic acid
gkwcagtrtrrtrggrc

SEQ ID NO: 13544 - DNA, 17 bp, Artificial Sequence
  Oligonucleotide probe
  misc_binding (1)..(17): Hybridization probe for the specific detection of mutant HIV-1 at codon 76 of the protease gene.
  modified_base (2)..(2): base is a locked nucleic acid
  modified_base (8)..(8): base is a locked nucleic acid
  modified_base (9)..(9): base is a locked nucleic acid
gkwcagtrtrrtrggrc

SEQ ID NO: 13545 - DNA, 17 bp, Artificial Sequence
  Oligonucleotide probe
  misc_binding (1)..(17): Hybridization probe for the specific detection of mutant HIV-1 at codon 76 of the protease gene.
  modified_base (5)..(5): base is a locked nucleic acid
  modified_base (8)..(8): base is a locked nucleic acid
  modified_base (9)..(9): base is a locked nucleic acid
gkwcagtrtrrtrggrc

SEQ ID NO: 13546 - DNA, 17 bp, Artificial Sequence
  Oligonucleotide probe
  misc_binding (1)..(17): Hybridization probe for the specific detection of mutant HIV-1 at codon 76 of the protease gene.
  modified_base (1)..(1): base is a locked nucleic acid
  modified_base (8)..(8): base is a locked nucleic acid
  modified_base (9)..(9): base is a locked nucleic acid
gkwcagtrtrrtrggrc

SEQ ID NO: 13547 - DNA, 17 bp, Artificial Sequence
  Oligonucleotide probe
  misc_binding (1)..(17): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (10)..(10): base is a locked nucleic acid
gkwcagtrtrrtrggrc

SEQ ID NO: 13548 - DNA, 17 bp, Artificial Sequence
  Oligonucleotide probe
  misc_binding (1)..(17): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (12)..(12): base is a locked nucleic acid
gkwcagtrtrrtrggrc

SEQ ID NO: 13549 - DNA, 17 bp, Artificial Sequence
  Oligonucleotide probe
  misc_binding (1)..(17): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (13)..(13): base is a locked nucleic acid
gkwcagtrtrrtrggrc

SEQ ID NO: 13550 - DNA, 17 bp, Artificial Sequence
  Oligonucleotide probe
  misc_binding (1)..(17): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (14)..(14): base is a locked nucleic acid
gkwcagtrtrrtrggrc

SEQ ID NO: 13551 - DNA, 15 bp, Artificial Sequence
  Oligonucleotide probe
  misc_binding (1)..(15): Hybridization probe for the specific detection of mutant HIV-1 at codon 76 of the protease gene.
  modified_base (8)..(8): base is a locked nucleic acid
  modified_base (9)..(9): base is a locked nucleic acid
gkwcagtrtrrtrgg

SEQ ID NO: 13552 - DNA, 15 bp, Artificial Sequence
  Oligonucleotide probe
  misc_binding (1)..(15): Hybridization probe for the specific detection of mutant HIV-1 at codon 76 of the protease gene.
  modified_base (6)..(6): base is a locked nucleic acid
gkwcagtrtrrtrgg

SEQ ID NO: 13553 - DNA, 15 bp, Artificial Sequence
  Oligonucleotide probe
  misc_binding (1)..(15): Hybridization probe for the specific detection of mutant HIV-1 at codon 76 of the protease gene.
  modified_base (3)..(3): base is a locked nucleic acid
gkwcagtrtrrtrgg

SEQ ID NO: 13554 - DNA, 15 bp, Artificial Sequence
  Oligonucleotide probe
  misc_binding (1)..(15): Hybridization probe for the specific detection of mutant HIV-1 at codon 76 of the protease gene.
  modified_base (8)..(8): base is a locked nucleic acid
gkwcagtrtrrtrgg

SEQ ID NO: 13555 - DNA, 15 bp, Artificial Sequence
  Oligonucleotide probe
  misc_binding (1)..(15): Hybridization probe for the specific detection of mutant HIV-1 at codon 76 of the protease gene.
  modified_base (1)..(1): base is a locked nucleic acid
gkwcagtrtrrtrgg

SEQ ID NO: 13556 - DNA, 16 bp, Artificial Sequence
  Oligonucleotide probe
  misc_binding (1)..(16): Hybridization probe for the specific detection of mutant HIV-1 at codon 76 of the protease gene.
gkwcagtrtrrtrggr

SEQ ID NO: 13557 - DNA, 15 bp, Artificial Sequence
  Oligonucleotide probe
  misc_binding (1)..(15): Hybridization probe for the specific detection of mutant HIV-1 at codon 76 of the protease gene.
  modified_base (13)..(13): base is a locked nucleic acid
gkwcagtrtrrtrgg

SEQ ID NO: 13558 - DNA, 15 bp, Artificial Sequence
  Oligonucleotide probe
  misc_binding (1)..(15): Hybridization probe for the specific detection of mutant HIV-1 at codon 76 of the protease gene.
  modified_base (11)..(11): base is a locked nucleic acid
gkwcagtrtrrtrgg

SEQ ID NO: 13559 - DNA, 15 bp, Artificial Sequence
  Oligonucleotide probe
  misc_binding (1)..(15): Hybridization probe for the specific detection of mutant HIV-1 at codon 76 of the protease gene.
  modified_base (9)..(9): base is a locked nucleic acid
gkwcagtrtrrtrgg

SEQ ID NO: 13560 - DNA, 15 bp, Artificial Sequence
  Oligonucleotide probe
  misc_binding (1)..(15): Hybridization probe for the specific detection of mutant HIV-1 at codon 76 of the protease gene.
  modified_base (4)..(4): base is a locked nucleic acid
  modified_base (8)..(8): base is a locked nucleic acid
  modified_base (9)..(9): base is a locked nucleic acid
gkwcagtrtrrtrgg

SEQ ID NO: 13561 - DNA, 15 bp, Artificial Sequence
  Oligonucleotide probe
  misc_binding (1)..(15): Hybridization probe for the specific detection of mutant HIV-1 at codon 76 of the protease gene.
  modified_base (2)..(2): base is a locked nucleic acid
  modified_base (8)..(8): base is a locked nucleic acid
  modified_base (9)..(9): base is a locked nucleic acid
gkwcagtrtrrtrgg

SEQ ID NO: 13562 - DNA, 15 bp, Artificial Sequence
  Oligonucleotide probe
  misc_binding (1)..(15): Hybridization probe for the specific detection of mutant HIV-1 at codon 76 of the protease gene.
  modified_base (5)..(5): base is a locked nucleic acid
  modified_base (8)..(8): base is a locked nucleic acid
  modified_base (9)..(9): base is a locked nucleic acid
gkwcagtrtrrtrgg

SEQ ID NO: 13563 - DNA, 15 bp, Artificial Sequence
  Oligonucleotide probe
  misc_binding (1)..(15): Hybridization probe for the specific detection of mutant HIV-1 at codon 76 of the protease gene.
  modified_base (1)..(1): base is a locked nucleic acid
  modified_base (8)..(8): base is a locked nucleic acid
  modified_base (9)..(9): base is a locked nucleic acid
gkwcagtrtrrtrgg

SEQ ID NO: 13564 - DNA, 15 bp, Artificial Sequence
  Oligonucleotide probe
  misc_binding (1)..(15): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (10)..(10): base is a locked nucleic acid
gkwcagtrtrrtrgg

SEQ ID NO: 13565 - DNA, 15 bp, Artificial Sequence
  Oligonucleotide probe
  misc_binding (1)..(15): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (12)..(12): base is a locked nucleic acid
gkwcagtrtrrtrgg

SEQ ID NO: 13566 - DNA, 15 bp, Artificial Sequence
  Oligonucleotide probe
  misc_binding (1)..(15): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (13)..(13): base is a locked nucleic acid
gkwcagtrtrrtrgg

SEQ ID NO: 13567 - DNA, 15 bp, Artificial Sequence
  Oligonucleotide probe
  misc_binding (1)..(15): Hybridization probe for the specific detection of mutant HIV-1 at codon 76 of the protease gene.
  modified_base (8)..(8): base is a locked nucleic acid
  modified_base (9)..(9): base is a locked nucleic acid
  modified_base (14)..(14): base is a locked nucleic acid
gkwcagtrtrrtrgg

SEQ ID NO: 13568 - DNA, 15 bp, Artificial Sequence
  Oligonucleotide probe
  misc_binding (1)..(15): Hybridization probe for the specific detection of mutant HIV-1 at codon 76 of the protease gene.
acagtagtrgtagga

SEQ ID NO: 13569 - DNA, 19 bp, Artificial Sequence
  Oligonucleotide probe
  misc_binding (1)..(19): Hybridization probe for the specific detection of mutant HIV-1 at codon 76 of the protease gene.
ggkwcagtrtrrtrggrcc

SEQ ID NO: 13570 - DNA, 18 bp, Artificial Sequence
  Oligonucleotide probe
  misc_binding (1)..(18): Hybridization probe for the specific detection of mutant HIV-1 at codon 76 of the protease gene.
ggkwcagtrtrrtrggrc

SEQ ID NO: 13571 - DNA, 17 bp, Artificial Sequence
  Oligonucleotide probe
  misc_binding (1)..(17): Hybridization probe for the specific detection of mutant HIV-1 at codon 76 of the protease gene.
gkwcagtrtrrtrggrc

SEQ ID NO: 13572 - DNA, 15 bp, Artificial Sequence
  Oligonucleotide probe
  misc_binding (1)..(15): Hybridization probe for the specific detection of mutant HIV-1 at codon 76 of the protease gene.
gkwcagtrtrrtrgg

SEQ ID NO: 13573 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
cyacacctrcaacataatt

SEQ ID NO: 13574 - DNA, 19 bp, Artificial Sequence
  Oligonucleotide probe
  misc_binding (1)..(19): Hybridization probe for the specific detection of mutant HIV-1 at codon 82 of the protease gene.
  modified_base (6)..(6): base is a locked nucleic acid
cyacacctrcaacataatt

SEQ ID NO: 13575 - DNA, 19 bp, Artificial Sequence
  Oligonucleotide probe
  misc_binding (1)..(19): Hybridization probe for the specific detection of mutant HIV-1 at codon 82 of the protease gene.
  modified_base (4)..(4): base is a locked nucleic acid
cyacacctrcaacataatt

SEQ ID NO: 13576 - DNA, 19 bp, Artificial Sequence
  Oligonucleotide probe
  misc_binding (1)..(19): Hybridization probe for the specific detection of mutant HIV-1 at codon 82 of the protease gene.
  modified_base (7)..(7): base is a locked nucleic acid
cyacacctrcaacataatt

SEQ ID NO: 13577 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
cyacacctrcaacataatt

SEQ ID NO: 13578 - DNA, 19 bp, Artificial Sequence
  Oligonucleotide probe
  misc_binding (1)..(19): Hybridization probe for the specific detection of mutant HIV-1 at codon 82 of the protease gene.
  modified_base (16)..(16): base is a locked nucleic acid
cyacacctrcaacataatt

SEQ ID NO: 13579 - DNA, 19 bp, Artificial Sequence
  Oligonucleotide probe
  misc_binding (1)..(19): Hybridization probe for the specific detection of mutant HIV-1 at codon 82 of the protease gene.
  modified_base (15)..(15): base is a locked nucleic acid
cyacacctrcaacataatt

SEQ ID NO: 13580 - DNA, 19 bp, Artificial Sequence
  Oligonucleotide probe
  misc_binding (1)..(19): Hybridization probe for the specific detection of mutant HIV-1 at codon 82 of the protease gene.
  modified_base (18)..(18): base is a locked nucleic acid
cyacacctrcaacataatt

SEQ ID NO: 13581 - DNA, 19 bp, Artificial Sequence
  Oligonucleotide probe
  misc_binding (1)..(19): Hybridization probe for the specific detection of mutant HIV-1 at codon 82 of the protease gene.
  modified_base (12)..(12): base is a locked nucleic acid
cyacacctrcaacataatt

SEQ ID NO: 13582 - DNA, 19 bp, Artificial Sequence
  Oligonucleotide probe
  misc_binding (1)..(19): Hybridization probe for the specific detection of mutant HIV-1 at codon 82 of the protease gene.
  modified_base (5)..(5): base is a locked nucleic acid
  modified_base (9)..(9): base is a locked nucleic acid
  modified_base (10)..(10): base is a locked nucleic acid
cyacacctrcaacataatt

SEQ ID NO: 13583 - DNA, 19 bp, Artificial Sequence
  Oligonucleotide probe
  misc_binding (1)..(19): Hybridization probe for the specific detection of mutant HIV-1 at codon 82 of the protease gene.
  modified_base (4)..(4): base is a locked nucleic acid
  modified_base (9)..(9): base is a locked nucleic acid
  modified_base (10)..(10): base is a locked nucleic acid
cyacacctrcaacataatt

SEQ ID NO: 13584 - DNA, 19 bp, Artificial Sequence
  Oligonucleotide probe
  misc_binding (1)..(19): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (10)..(10): base is a locked nucleic acid
cyacacctrcaacataatt

SEQ ID NO: 13585 - DNA, 19 bp, Artificial Sequence
  Oligonucleotide probe
  misc_binding (1)..(19): Hybridization probe for the specific detection of mutant HIV-1 at codon 82 of the protease gene.
  modified_base (2)..(2): base is a locked nucleic acid
  modified_base (9)..(9): base is a locked nucleic acid
  modified_base (10)..(10): base is a locked nucleic acid
cyacacctrcaacataatt

SEQ ID NO: 13586 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (14)..(14): base is a locked nucleic acid
cyacacctrcaacataatt

SEQ ID NO: 13587 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (18)..(18): base is a locked nucleic acid
cyacacctrcaacataatt

SEQ ID NO: 13588 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (15)..(15): base is a locked nucleic acid
cyacacctrcaacataatt

SEQ ID NO: 13589 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (13)..(13): base is a locked nucleic acid
cyacacctrcaacataatt

SEQ ID NO: 13590 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
ccyacaccttcaacataat

SEQ ID NO: 13591 - DNA, 19 bp, Artificial Sequence
  Oligonucleotide probe
  misc_binding (1)..(19): Hybridization probe for the specific detection of mutant HIV-1 at codon 82 of the protease gene.
  modified_base (5)..(5): base is a locked nucleic acid
ccyacaccttcaacataat

SEQ ID NO: 13592 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
ccyacaccttcaacataat

SEQ ID NO: 13593 - DNA, 19 bp, Artificial Sequence
  Oligonucleotide probe
  misc_binding (1)..(19): Hybridization probe for the specific detection of mutant HIV-1 at codon 82 of the protease gene.
  modified_base (3)..(3): base is a locked nucleic acid
ccyacaccttcaacataat

SEQ ID NO: 13594 - DNA, 19 bp, Artificial Sequence
  Oligonucleotide probe
  misc_binding (1)..(19): Hybridization probe for the specific detection of mutant HIV-1 at codon 82 of the protease gene.
  modified_base (8)..(8): base is a locked nucleic acid
ccyacaccttcaacataat

SEQ ID NO: 13595 - DNA, 19 bp, Artificial Sequence
  Oligonucleotide probe
  misc_binding (1)..(19): Hybridization probe for the specific detection of mutant HIV-1 at codon 82 of the protease gene.
  modified_base (14)..(14): base is a locked nucleic acid
ccyacaccttcaacataat

SEQ ID NO: 13596 - DNA, 19 bp, Artificial Sequence
  Oligonucleotide probe
  misc_binding (1)..(19): Hybridization probe for the specific detection of mutant HIV-1 at codon 82 of the protease gene.
  modified_base (15)..(15): base is a locked nucleic acid
ccyacaccttcaacataat

SEQ ID NO: 13597 - DNA, 19 bp, Artificial Sequence
  Oligonucleotide probe
  misc_binding (1)..(19): Hybridization probe for the specific detection of mutant HIV-1 at codon 82 of the protease gene.
  modified_base (16)..(16): base is a locked nucleic acid
ccyacaccttcaacataat

SEQ ID NO: 13598 - DNA, 19 bp, Artificial Sequence
  Oligonucleotide probe
  misc_binding (1)..(19): Hybridization probe for the specific detection of mutant HIV-1 at codon 82 of the protease gene.
  modified_base (12)..(12): base is a locked nucleic acid
ccyacaccttcaacataat

SEQ ID NO: 13599 - DNA, 19 bp, Artificial Sequence
  Oligonucleotide probe
  misc_binding (1)..(19): Hybridization probe for the specific detection of mutant HIV-1 at codon 82 of the protease gene.
  modified_base (4)..(4): base is a locked nucleic acid
  modified_base (9)..(9): base is a locked nucleic acid
  modified_base (10)..(10): base is a locked nucleic acid
ccyacaccttcaacataat

SEQ ID NO: 13600 - DNA, 19 bp, Artificial Sequence
  Oligonucleotide probe
  misc_binding (1)..(19): Hybridization probe for the specific detection of mutant HIV-1 at codon 82 of the protease gene.
  modified_base (3)..(3): base is a locked nucleic acid
  modified_base (9)..(9): base is a locked nucleic acid
  modified_base (10)..(10): base is a locked nucleic acid
ccyacaccttcaacataat

SEQ ID NO: 13601 - DNA, 19 bp, Artificial Sequence
  Oligonucleotide probe
  misc_binding (1)..(19): Hybridization probe for the specific detection of mutant HIV-1 at codon 82 of the protease gene.
  modified_base (2)..(2): base is a locked nucleic acid
  modified_base (9)..(9): base is a locked nucleic acid
  modified_base (10)..(10): base is a locked nucleic acid
ccyacaccttcaacataat

SEQ ID NO: 13602 - DNA, 19 bp, Artificial Sequence
  Oligonucleotide probe
  misc_binding (1)..(19): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (10)..(10): base is a locked nucleic acid
ccyacaccttcaacataat

SEQ ID NO: 13603 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (12)..(12): base is a locked nucleic acid
ccyacaccttcaacataat

SEQ ID NO: 13604 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (15)..(15): base is a locked nucleic acid
ccyacaccttcaacataat

SEQ ID NO: 13605 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (13)..(13): base is a locked nucleic acid
ccyacaccttcaacataat

SEQ ID NO: 13606 - DNA, 19 bp, Artificial Sequence
  Oligonucleotide probe
  misc_binding (1)..(19): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (17)..(17): base is a locked nucleic acid
ccyacaccttcaacataat

SEQ ID NO: 13607 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
cyacacctrcaacataat

SEQ ID NO: 13608 - DNA, 18 bp, Artificial Sequence
  Oligonucleotide probe
  misc_binding (1)..(18): Hybridization probe for the specific detection of mutant HIV-1 at codon 82 of the protease gene.
  modified_base (6)..(6): base is a locked nucleic acid
cyacacctrcaacataat

SEQ ID NO: 13609 - DNA, 18 bp, Artificial Sequence
  Oligonucleotide probe
  misc_binding (1)..(18): Hybridization probe for the specific detection of mutant HIV-1 at codon 82 of the protease gene.
  modified_base (4)..(4): base is a locked nucleic acid
cyacacctrcaacataat

SEQ ID NO: 13610 - DNA, 18 bp, Artificial Sequence
  Oligonucleotide probe
  misc_binding (1)..(18): Hybridization probe for the specific detection of mutant HIV-1 at codon 82 of the protease gene.
  modified_base (7)..(7): base is a locked nucleic acid
cyacacctrcaacataat

SEQ ID NO: 13611 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
cyacacctrcaacataat

SEQ ID NO: 13612 - DNA, 18 bp, Artificial Sequence
  Oligonucleotide probe
  misc_binding (1)..(18): Hybridization probe for the specific detection of mutant HIV-1 at codon 82 of the protease gene.
  modified_base (16)..(16): base is a locked nucleic acid
cyacacctrcaacataat

SEQ ID NO: 13613 - DNA, 18 bp, Artificial Sequence
  Oligonucleotide probe
  misc_binding (1)..(18): Hybridization probe for the specific detection of mutant HIV-1 at codon 82 of the protease gene.
  modified_base (15)..(15): base is a locked nucleic acid
cyacacctrcaacataat

SEQ ID NO: 13614 - DNA, 18 bp, Artificial Sequence
  Oligonucleotide probe
  misc_binding (1)..(18): Hybridization probe for the specific detection of mutant HIV-1 at codon 82 of the protease gene.
  modified_base (18)..(18): base is a locked nucleic acid
cyacacctrcaacataat

SEQ ID NO: 13615 - DNA, 18 bp, Artificial Sequence
  Oligonucleotide probe
  misc_binding (1)..(18): Hybridization probe for the specific detection of mutant HIV-1 at codon 82 of the protease gene.
  modified_base (12)..(12): base is a locked nucleic acid
cyacacctrcaacataat

SEQ ID NO: 13616 - DNA, 18 bp, Artificial Sequence
  Oligonucleotide probe
  misc_binding (1)..(18): Hybridization probe for the specific detection of mutant HIV-1 at codon 82 of the protease gene.
  modified_base (5)..(5): base is a locked nucleic acid
  modified_base (9)..(9): base is a locked nucleic acid
  modified_base (10)..(10): base is a locked nucleic acid
cyacacctrcaacataat

SEQ ID NO: 13617 - DNA, 18 bp, Artificial Sequence
  Oligonucleotide probe
  misc_binding (1)..(18): Hybridization probe for the specific detection of mutant HIV-1 at codon 82 of the protease gene.
  modified_base (4)..(4): base is a locked nucleic acid
  modified_base (9)..(9): base is a locked nucleic acid
  modified_base (10)..(10): base is a locked nucleic acid
cyacacctrcaacataat

SEQ ID NO: 13618 - DNA, 18 bp, Artificial Sequence
  Oligonucleotide probe
  misc_binding (1)..(18): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (10)..(10): base is a locked nucleic acid
cyacacctrcaacataat

SEQ ID NO: 13619 - DNA, 18 bp, Artificial Sequence
  Oligonucleotide probe
  misc_binding (1)..(18): Hybridization probe for the specific detection of mutant HIV-1 at codon 82 of the protease gene.
  modified_base (2)..(2): base is a locked nucleic acid
  modified_base (9)..(9): base is a locked nucleic acid
  modified_base (10)..(10): base is a locked nucleic acid
cyacacctrcaacataat

SEQ ID NO: 13620 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (14)..(14): base is a locked nucleic acid
cyacacctrcaacataat

SEQ ID NO: 13621 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (18)..(18): base is a locked nucleic acid
cyacacctrcaacataat

SEQ ID NO: 13622 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (15)..(15): base is a locked nucleic acid
cyacacctrcaacataat

SEQ ID NO: 13623 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (13)..(13): base is a locked nucleic acid
cyacacctrcaacataat

SEQ ID NO: 13624 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
ccyacaccttcaacataa

SEQ ID NO: 13625 - DNA, 18 bp, Artificial Sequence
  Oligonucleotide probe
  misc_binding (1)..(18): Hybridization probe for the specific detection of mutant HIV-1 at codon 82 of the protease gene.
  modified_base (5)..(5): base is a locked nucleic acid
ccyacaccttcaacataa

SEQ ID NO: 13626 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
ccyacaccttcaacataa

SEQ ID NO: 13627 - DNA, 18 bp, Artificial Sequence
  Oligonucleotide probe
  misc_binding (1)..(18): Hybridization probe for the specific detection of mutant HIV-1 at codon 82 of the protease gene.
  modified_base (3)..(3): base is a locked nucleic acid
ccyacaccttcaacataa

SEQ ID NO: 13628 - DNA, 18 bp, Artificial Sequence
  Oligonucleotide probe
  misc_binding (1)..(18): Hybridization probe for the specific detection of mutant HIV-1 at codon 82 of the protease gene.
  modified_base (8)..(8): base is a locked nucleic acid
ccyacaccttcaacataa

SEQ ID NO: 13629 - DNA, 18 bp, Artificial Sequence
  Oligonucleotide probe
  misc_binding (1)..(18): Hybridization probe for the specific detection of mutant HIV-1 at codon 82 of the protease gene.
  modified_base (14)..(14): base is a locked nucleic acid
ccyacaccttcaacataa

SEQ ID NO: 13630 - DNA, 18 bp, Artificial Sequence
  Oligonucleotide probe
  misc_binding (1)..(18): Hybridization probe for the specific detection of mutant HIV-1 at codon 82 of the protease gene.
  modified_base (15)..(15): base is a locked nucleic acid
ccyacaccttcaacataa

SEQ ID NO: 13631 - DNA, 18 bp, Artificial Sequence
  Oligonucleotide probe
  misc_binding (1)..(18): Hybridization probe for the specific detection of mutant HIV-1 at codon 82 of the protease gene.
  modified_base (16)..(16): base is a locked nucleic acid
ccyacaccttcaacataa

SEQ ID NO: 13632 - DNA, 18 bp, Artificial Sequence
  Oligonucleotide probe
  misc_binding (1)..(18): Hybridization probe for the specific detection of mutant HIV-1 at codon 82 of the protease gene.
  modified_base (12)..(12): base is a locked nucleic acid
ccyacaccttcaacataa

SEQ ID NO: 13633 - DNA, 18 bp, Artificial Sequence
  Oligonucleotide probe
  misc_binding (1)..(18): Hybridization probe for the specific detection of mutant HIV-1 at codon 82 of the protease gene.
  modified_base (4)..(4): base is a locked nucleic acid
  modified_base (9)..(9): base is a locked nucleic acid
  modified_base (10)..(10): base is a locked nucleic acid
ccyacaccttcaacataa

SEQ ID NO: 13634 - DNA, 18 bp, Artificial Sequence
  Oligonucleotide probe
  misc_binding (1)..(18): Hybridization probe for the specific detection of mutant HIV-1 at codon 82 of the protease gene.
  modified_base (3)..(3): base is a locked nucleic acid
  modified_base (9)..(9): base is a locked nucleic acid
  modified_base (10)..(10): base is a locked nucleic acid
ccyacaccttcaacataa

SEQ ID NO: 13635 - DNA, 18 bp, Artificial Sequence
  Oligonucleotide probe
  misc_binding (1)..(18): Hybridization probe for the specific detection of mutant HIV-1 at codon 82 of the protease gene.
  modified_base (2)..(2): base is a locked nucleic acid
  modified_base (9)..(9): base is a locked nucleic acid
  modified_base (10)..(10): base is a locked nucleic acid
ccyacaccttcaacataa

SEQ ID NO: 13636 - DNA, 18 bp, Artificial Sequence
  Oligonucleotide probe
  misc_binding (1)..(18): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (10)..(10): base is a locked nucleic acid
ccyacaccttcaacataa

SEQ ID NO: 13637 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (12)..(12): base is a locked nucleic acid
ccyacaccttcaacataa

SEQ ID NO: 13638 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (15)..(15): base is a locked nucleic acid
ccyacaccttcaacataa

SEQ ID NO: 13639 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (13)..(13): base is a locked nucleic acid
ccyacaccttcaacataa

SEQ ID NO: 13640 - DNA, 18 bp, Artificial Sequence
  Oligonucleotide probe
  misc_binding (1)..(18): Hybridization probe for the specific detection of mutant HIV-1 at codon 82 of the protease gene.
  modified_base (9)..(9): base is a locked nucleic acid
  modified_base (10)..(10): base is a locked nucleic acid
  modified_base (17)..(17): base is a locked nucleic acid
ccyacaccttcaacataa

SEQ ID NO: 13641 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
yacacctrcaacataat

SEQ ID NO: 13642 - DNA, 17 bp, Artificial Sequence
  Oligonucleotide probe
  misc_binding (1)..(17): Hybridization probe for the specific detection of mutant HIV-1 at codon 82 of the protease gene.
  modified_base (5)..(5): base is a locked nucleic acid
yacacctrcaacataat

SEQ ID NO: 13643 - DNA, 17 bp, Artificial Sequence
  Oligonucleotide probe
  misc_binding (1)..(17): Hybridization probe for the specific detection of mutant HIV-1 at codon 82 of the protease gene.
  modified_base (3)..(3): base is a locked nucleic acid
yacacctrcaacataat

SEQ ID NO: 13644 - DNA, 17 bp, Artificial Sequence
  Oligonucleotide probe
  misc_binding (1)..(17): Hybridization probe for the specific detection of mutant HIV-1 at codon 82 of the protease gene.
  modified_base (6)..(6): base is a locked nucleic acid
yacacctrcaacataat

SEQ ID NO: 13645 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
yacacctrcaacataat

SEQ ID NO: 13646 - DNA, 17 bp, Artificial Sequence
  Oligonucleotide probe
  misc_binding (1)..(17): Hybridization probe for the specific detection of mutant HIV-1 at codon 82 of the protease gene.
  modified_base (15)..(15): base is a locked nucleic acid
yacacctrcaacataat

SEQ ID NO: 13647 - DNA, 17 bp, Artificial Sequence
  Oligonucleotide probe
  misc_binding (1)..(17): Hybridization probe for the specific detection of mutant HIV-1 at codon 82 of the protease gene.
  modified_base (14)..(14): base is a locked nucleic acid
yacacctrcaacataat

SEQ ID NO: 13648 - DNA, 17 bp, Artificial Sequence
  Oligonucleotide probe
  misc_binding (1)..(17): Hybridization probe for the specific detection of mutant HIV-1 at codon 82 of the protease gene.
  modified_base (17)..(17): base is a locked nucleic acid
yacacctrcaacataat

SEQ ID NO: 13649 - DNA, 17 bp, Artificial Sequence
  Oligonucleotide probe
  misc_binding (1)..(17): Hybridization probe for the specific detection of mutant HIV-1 at codon 82 of the protease gene.
  modified_base (11)..(11): base is a locked nucleic acid
yacacctrcaacataat

SEQ ID NO: 13650 - DNA, 17 bp, Artificial Sequence
  Oligonucleotide probe
  misc_binding (1)..(17): Hybridization probe for the specific detection of mutant HIV-1 at codon 82 of the protease gene.
  modified_base (4)..(4): base is a locked nucleic acid
  modified_base (8)..(8): base is a locked nucleic acid
  modified_base (9)..(9): base is a locked nucleic acid
yacacctrcaacataat

SEQ ID NO: 13651 - DNA, 17 bp, Artificial Sequence
  Oligonucleotide probe
  misc_binding (1)..(17): Hybridization probe for the specific detection of mutant HIV-1 at codon 82 of the protease gene.
  modified_base (3)..(3): base is a locked nucleic acid
  modified_base (8)..(8): base is a locked nucleic acid
  modified_base (9)..(9): base is a locked nucleic acid
yacacctrcaacataat

SEQ ID NO: 13652 - DNA, 17 bp, Artificial Sequence
  Oligonucleotide probe
  misc_binding (1)..(17): Hybridization probe for the specific detection of mutant HIV-1 at codon 82 of the protease gene.
  modified_base (7)..(7): base is a locked nucleic acid
  modified_base (8)..(8): base is a locked nucleic acid
  modified_base (9)..(9): base is a locked nucleic acid
yacacctrcaacataat

SEQ ID NO: 13653 - DNA, 17 bp, Artificial Sequence
  Oligonucleotide probe
  misc_binding (1)..(17): Hybridization probe for the specific detection of mutant HIV-1 at codon 82 of the protease gene.
  modified_base (1)..(1): base is a locked nucleic acid
  modified_base (8)..(8): base is a locked nucleic acid
  modified_base (9)..(9): base is a locked nucleic acid
yacacctrcaacataat

SEQ ID NO: 13654 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (13)..(13): base is a locked nucleic acid
yacacctrcaacataat

SEQ ID NO: 13655 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (17)..(17): base is a locked nucleic acid
yacacctrcaacataat

SEQ ID NO: 13656 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (14)..(14): base is a locked nucleic acid
yacacctrcaacataat

SEQ ID NO: 13657 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (12)..(12): base is a locked nucleic acid
yacacctrcaacataat

SEQ ID NO: 13658 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
cyacaccttcaacataa

SEQ ID NO: 13659 - DNA, 17 bp, Artificial Sequence
  Oligonucleotide probe
  misc_binding (1)..(17): Hybridization probe for the specific detection of mutant HIV-1 at codon 82 of the protease gene.
  modified_base (4)..(4): base is a locked nucleic acid
cyacaccttcaacataa

SEQ ID NO: 13660 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
cyacaccttcaacataa

SEQ ID NO: 13661 - DNA, 17 bp, Artificial Sequence
  Oligonucleotide probe
  misc_binding (1)..(17): Hybridization probe for the specific detection of mutant HIV-1 at codon 82 of the protease gene.
  modified_base (2)..(2): base is a locked nucleic acid
cyacaccttcaacataa

SEQ ID NO: 13662 - DNA, 17 bp, Artificial Sequence
  Oligonucleotide probe
  misc_binding (1)..(17): Hybridization probe for the specific detection of mutant HIV-1 at codon 82 of the protease gene.
  modified_base (7)..(7): base is a locked nucleic acid
cyacaccttcaacataa

SEQ ID NO: 13663 - DNA, 17 bp, Artificial Sequence
  Oligonucleotide probe
  misc_binding (1)..(17): Hybridization probe for the specific detection of mutant HIV-1 at codon 82 of the protease gene.
  modified_base (13)..(13): base is a locked nucleic acid
cyacaccttcaacataa

SEQ ID NO: 13664 - DNA, 17 bp, Artificial Sequence
  Oligonucleotide probe
  misc_binding (1)..(17): Hybridization probe for the specific detection of mutant HIV-1 at codon 82 of the protease gene.
  modified_base (14)..(14): base is a locked nucleic acid
cyacaccttcaacataa

SEQ ID NO: 13665 - DNA, 17 bp, Artificial Sequence
  Oligonucleotide probe
  misc_binding (1)..(17): Hybridization probe for the specific detection of mutant HIV-1 at codon 82 of the protease gene.
  modified_base (15)..(15): base is a locked nucleic acid
cyacaccttcaacataa

SEQ ID NO: 13666 - DNA, 17 bp, Artificial Sequence
  Oligonucleotide probe
  misc_binding (1)..(17): Hybridization probe for the specific detection of mutant HIV-1 at codon 82 of the protease gene.
  modified_base (11)..(11): base is a locked nucleic acid
cyacaccttcaacataa

SEQ ID NO: 13667 - DNA, 17 bp, Artificial Sequence
  Oligonucleotide probe
  misc_binding (1)..(17): Hybridization probe for the specific detection of mutant HIV-1 at codon 82 of the protease gene.
  modified_base (3)..(3): base is a locked nucleic acid
  modified_base (8)..(8): base is a locked nucleic acid
  modified_base (9)..(9): base is a locked nucleic acid
cyacaccttcaacataa

SEQ ID NO: 13668 - DNA, 17 bp, Artificial Sequence
  Oligonucleotide probe
  misc_binding (1)..(17): Hybridization probe for the specific detection of mutant HIV-1 at codon 82 of the protease gene.
  modified_base (2)..(2): base is a locked nucleic acid
  modified_base (8)..(8): base is a locked nucleic acid
  modified_base (9)..(9): base is a locked nucleic acid
cyacaccttcaacataa

SEQ ID NO: 13669 - DNA, 17 bp, Artificial Sequence
  Oligonucleotide probe
  misc_binding (1)..(17): Hybridization probe for the specific detection of mutant HIV-1 at codon 82 of the protease gene.
  modified_base (1)..(1): base is a locked nucleic acid
  modified_base (8)..(8): base is a locked nucleic acid
  modified_base (9)..(9): base is a locked nucleic acid
cyacaccttcaacataa

SEQ ID NO: 13670 - DNA, 17 bp, Artificial Sequence
  Oligonucleotide probe
  misc_binding (1)..(17): Hybridization probe for the specific detection of mutant HIV-1 at codon 82 of the protease gene.
  modified_base (7)..(7): base is a locked nucleic acid
  modified_base (8)..(8): base is a locked nucleic acid
  modified_base (9)..(9): base is a locked nucleic acid
cyacaccttcaacataa

SEQ ID NO: 13671 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (11)..(11): base is a locked nucleic acid
cyacaccttcaacataa

SEQ ID NO: 13672 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (14)..(14): base is a locked nucleic acid
cyacaccttcaacataa

SEQ ID NO: 13673 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (12)..(12): base is a locked nucleic acid
cyacaccttcaacataa

SEQ ID NO: 13674 - DNA, 17 bp, Artificial Sequence
  Oligonucleotide probe
  misc_binding (1)..(17): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (16)..(16): base is a locked nucleic acid
cyacaccttcaacataa

SEQ ID NO: 13675 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
yacacctrcaacata

SEQ ID NO: 13676 - DNA, 15 bp, Artificial Sequence
  Oligonucleotide probe
  misc_binding (1)..(15): Hybridization probe for the specific detection of mutant HIV-1 at codon 82 of the protease gene.
  modified_base (5)..(5): base is a locked nucleic acid
yacacctrcaacata

SEQ ID NO: 13677 - DNA, 15 bp, Artificial Sequence
  Oligonucleotide probe
  misc_binding (1)..(15): Hybridization probe for the specific detection of mutant HIV-1 at codon 82 of the protease gene.
  modified_base (3)..(3): base is a locked nucleic acid
yacacctrcaacata

SEQ ID NO: 13678 - DNA, 15 bp, Artificial Sequence
  Oligonucleotide probe
  misc_binding (1)..(15): Hybridization probe for the specific detection of mutant HIV-1 at codon 82 of the protease gene.
  modified_base (6)..(6): base is a locked nucleic acid
yacacctrcaacata

SEQ ID NO: 13679 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
yacacctrcaacata

SEQ ID NO: 13680 - DNA, 15 bp, Artificial Sequence
  Oligonucleotide probe
  misc_binding (1)..(15): Hybridization probe for the specific detection of mutant HIV-1 at codon 82 of the protease gene.
  modified_base (15)..(15): base is a locked nucleic acid
yacacctrcaacata

SEQ ID NO: 13681 - DNA, 15 bp, Artificial Sequence
  Oligonucleotide probe
  misc_binding (1)..(15): Hybridization probe for the specific detection of mutant HIV-1 at codon 82 of the protease gene.
  modified_base (14)..(14): base is a locked nucleic acid
yacacctrcaacata

SEQ ID NO: 13682 - DNA, 16 bp, Artificial Sequence
  Oligonucleotide probe
  misc_binding (1)..(16): Hybridization probe for the specific detection of mutant HIV-1 at codon 82 of the protease gene.
yacacctrcaacataa

SEQ ID NO: 13683 - DNA, 15 bp, Artificial Sequence
  Oligonucleotide probe
  misc_binding (1)..(15): Hybridization probe for the specific detection of mutant HIV-1 at codon 82 of the protease gene.
  modified_base (11)..(11): base is a locked nucleic acid
yacacctrcaacata

SEQ ID NO: 13684 - DNA, 15 bp, Artificial Sequence
  Oligonucleotide probe
  misc_binding (1)..(15): Hybridization probe for the specific detection of mutant HIV-1 at codon 82 of the protease gene.
  modified_base (4)..(4): base is a locked nucleic acid
  modified_base (8)..(8): base is a locked nucleic acid
  modified_base (9)..(9): base is a locked nucleic acid
yacacctrcaacata

SEQ ID NO: 13685 - DNA, 15 bp, Artificial Sequence
  Oligonucleotide probe
  misc_binding (1)..(15): Hybridization probe for the specific detection of mutant HIV-1 at codon 82 of the protease gene.
  modified_base (3)..(3): base is a locked nucleic acid
  modified_base (8)..(8): base is a locked nucleic acid
  modified_base (9)..(9): base is a locked nucleic acid
yacacctrcaacata

SEQ ID NO: 13686 - DNA, 15 bp, Artificial Sequence
  Oligonucleotide probe
  misc_binding (1)..(15): Hybridization probe for the specific detection of mutant HIV-1 at codon 82 of the protease gene.
  modified_base (7)..(7): base is a locked nucleic acid
  modified_base (8)..(8): base is a locked nucleic acid
  modified_base (9)..(9): base is a locked nucleic acid
yacacctrcaacata

SEQ ID NO: 13687 - DNA, 15 bp, Artificial Sequence
  Oligonucleotide probe
  misc_binding (1)..(15): Hybridization probe for the specific detection of mutant HIV-1 at codon 82 of the protease gene.
  modified_base (1)..(1): base is a locked nucleic acid
  modified_base (8)..(8): base is a locked nucleic acid
  modified_base (9)..(9): base is a locked nucleic acid
yacacctrcaacata

SEQ ID NO: 13688 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (13)..(13): base is a locked nucleic acid
yacacctrcaacata

SEQ ID NO: 13689 - DNA, 16 bp, Artificial Sequence
  Oligonucleotide probe
  misc_binding (1)..(16): Hybridization probe for the specific detection of mutant HIV-1 at codon 82 of the protease gene.
  modified_base (8)..(8): base is a locked nucleic acid
  modified_base (9)..(9): base is a locked nucleic acid
yacacctrcaacataa

SEQ ID NO: 13690 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (14)..(14): base is a locked nucleic acid
yacacctrcaacata

SEQ ID NO: 13691 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (12)..(12): base is a locked nucleic acid
yacacctrcaacata

SEQ ID NO: 13692 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
cyacaccttcaacat

SEQ ID NO: 13693 - DNA, 15 bp, Artificial Sequence
  Oligonucleotide probe
  misc_binding (1)..(15): Hybridization probe for the specific detection of mutant HIV-1 at codon 82 of the protease gene.
  modified_base (4)..(4): base is a locked nucleic acid
cyacaccttcaacat

SEQ ID NO: 13694 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
cyacaccttcaacat

SEQ ID NO: 13695 - DNA, 15 bp, Artificial Sequence
  Oligonucleotide probe
  misc_binding (1)..(15): Hybridization probe for the specific detection of mutant HIV-1 at codon 82 of the protease gene.
  modified_base (2)..(2): base is a locked nucleic acid
cyacaccttcaacat

SEQ ID NO: 13696 - DNA, 15 bp, Artificial Sequence
  Oligonucleotide probe
  misc_binding (1)..(15): Hybridization probe for the specific detection of mutant HIV-1 at codon 82 of the protease gene.
  modified_base (7)..(7): base is a locked nucleic acid
cyacaccttcaacat

SEQ ID NO: 13697 - DNA, 15 bp, Artificial Sequence
  Oligonucleotide probe
  misc_binding (1)..(15): Hybridization probe for the specific detection of mutant HIV-1 at codon 82 of the protease gene.
  modified_base (13)..(13): base is a locked nucleic acid
cyacaccttcaacat

SEQ ID NO: 13698 - DNA, 15 bp, Artificial Sequence
  Oligonucleotide probe
  misc_binding (1)..(15): Hybridization probe for the specific detection of mutant HIV-1 at codon 82 of the protease gene.
  modified_base (14)..(14): base is a locked nucleic acid
cyacaccttcaacat

SEQ ID NO: 13699 - DNA, 15 bp, Artificial Sequence
  Oligonucleotide probe
  misc_binding (1)..(15): Hybridization probe for the specific detection of mutant HIV-1 at codon 82 of the protease gene.
  modified_base (15)..(15): base is a locked nucleic acid
cyacaccttcaacat

SEQ ID NO: 13700 - DNA, 15 bp, Artificial Sequence
  Oligonucleotide probe
  misc_binding (1)..(15): Hybridization probe for the specific detection of mutant HIV-1 at codon 82 of the protease gene.
  modified_base (11)..(11): base is a locked nucleic acid
cyacaccttcaacat

SEQ ID NO: 13701 - DNA, 15 bp, Artificial Sequence
  Oligonucleotide probe
  misc_binding (1)..(15): Hybridization probe for the specific detection of mutant HIV-1 at codon 82 of the protease gene.
  modified_base (3)..(3): base is a locked nucleic acid
  modified_base (8)..(8): base is a locked nucleic acid
  modified_base (9)..(9): base is a locked nucleic acid
cyacaccttcaacat

SEQ ID NO: 13702 - DNA, 15 bp, Artificial Sequence
  Oligonucleotide probe
  misc_binding (1)..(15): Hybridization probe for the specific detection of mutant HIV-1 at codon 82 of the protease gene.
  modified_base (2)..(2): base is a locked nucleic acid
  modified_base (8)..(8): base is a locked nucleic acid
  modified_base (9)..(9): base is a locked nucleic acid
cyacaccttcaacat

SEQ ID NO: 13703 - DNA, 15 bp, Artificial Sequence
  Oligonucleotide probe
  misc_binding (1)..(15): Hybridization probe for the specific detection of mutant HIV-1 at codon 82 of the protease gene.
  modified_base (1)..(1): base is a locked nucleic acid
  modified_base (8)..(8): base is a locked nucleic acid
  modified_base (9)..(9): base is a locked nucleic acid
cyacaccttcaacat

SEQ ID NO: 13704 - DNA, 15 bp, Artificial Sequence
  Oligonucleotide probe
  misc_binding (1)..(15): Hybridization probe for the specific detection of mutant HIV-1 at codon 82 of the protease gene.
  modified_base (7)..(7): base is a locked nucleic acid
  modified_base (8)..(8): base is a locked nucleic acid
  modified_base (9)..(9): base is a locked nucleic acid
cyacaccttcaacat

SEQ ID NO: 13705 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (11)..(11): base is a locked nucleic acid
cyacaccttcaacat

SEQ ID NO: 13706 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (14)..(14): base is a locked nucleic acid
cyacaccttcaacat

SEQ ID NO: 13707 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
  modified_base (12)..(12): base is a locked nucleic acid
cyacaccttcaacat

SEQ ID NO: 13708 - DNA, 15 bp, Artificial Sequence
  Oligonucleotide probe
  misc_binding (1)..(15): Hybridization probe for the specific detection of mutant HIV-1 at codon 82 of the protease gene.
  modified_base (8)..(8): base is a locked nucleic acid
  modified_base (9)..(9): base is a locked nucleic acid
cyacaccttcaacat

SEQ ID NO: 13709 - DNA, 15 bp, Artificial Sequence
  Oligonucleotide probe
  misc_binding (1)..(15): Hybridization probe for the specific detection of mutant HIV-1 at codon 82 of the protease gene.
acacctgcyaacata

SEQ ID NO: 13710 - DNA, 15 bp, Artificial Sequence
  Oligonucleotide probe
  misc_binding (1)..(15): Hybridization probe for the specific detection of mutant HIV-1 at codon 82 of the protease gene.
acacctacyaacata

SEQ ID NO: 13711 - DNA, 15 bp, Artificial Sequence
  Oligonucleotide probe
  misc_binding (1)..(15): Hybridization probe for the specific detection of mutant HIV-1 at codon 82 of the protease gene.
acacctagyaacata

SEQ ID NO: 13712 - DNA, 15 bp, Artificial Sequence
  Oligonucleotide probe
  misc_binding (1)..(15): Hybridization probe for the specific detection of mutant HIV-1 at codon 82 of the protease gene.
acacctttyaacata

SEQ ID NO: 13713 - DNA, 15 bp, Artificial Sequence
  Oligonucleotide probe
  misc_binding (1)..(15): Hybridization probe for the specific detection of mutant HIV-1 at codon 82 of the protease gene.
acacctctyaacata

SEQ ID NO: 13714 - DNA, 15 bp, Artificial Sequence
  Oligonucleotide probe
  misc_binding (1)..(15): Hybridization probe for the specific detection of mutant HIV-1 at codon 82 of the protease gene.
acaccttgyaacata

SEQ ID NO: 13715 - DNA, 15 bp, Artificial Sequence
  Oligonucleotide probe
  misc_binding (1)..(15): Hybridization probe for the specific detection of mutant HIV-1 at codon 82 of the protease gene.
acacctatgaacata

SEQ ID NO: 13716 - DNA, 19 bp, Artificial Sequence
  Oligonucleotide probe
  misc_binding (1)..(19): Hybridization probe for the specific detection of mutant HIV-1 at codon 82 of the protease gene.
cyacacctrcaacataatt

SEQ ID NO: 13717 - DNA, 19 bp, Artificial Sequence
  Oligonucleotide probe
  misc_binding (1)..(19): Hybridization probe for the specific detection of mutant HIV-1 at codon 82 of the protease gene.
ccyacaccttcaacataat

SEQ ID NO: 13718 - DNA, 18 bp, Artificial Sequence
  Oligonucleotide probe
  misc_binding (1)..(18): Hybridization probe for the specific detection of mutant HIV-1 at codon 82 of the protease gene.
cyacacctrcaacataat

SEQ ID NO: 13719 - DNA, 18 bp, Artificial Sequence
  Oligonucleotide probe
  misc_binding (1)..(18): Hybridization probe for the specific detection of mutant HIV-1 at codon 82 of the protease gene.
ccyacaccttcaacataa

SEQ ID NO: 13720 - DNA, 17 bp, Artificial Sequence
  Oligonucleotide probe
  misc_binding (1)..(17): Hybridization probe for the specific detection of mutant HIV-1 at codon 82 of the protease gene.
yacacctrcaacataat

SEQ ID NO: 13721 - DNA, 17 bp, Artificial Sequence
  Oligonucleotide probe
  misc_binding (1)..(17): Hybridization probe for the specific detection of mutant HIV-1 at codon 82 of the protease gene.
cyacaccttcaacataa

SEQ ID NO: 13722 - DNA, 15 bp, Artificial Sequence
  Oligonucleotide probe
  misc_binding (1)..(15): Hybridization probe for the specific detection of mutant HIV-1 at codon 82 of the protease gene.
yacacctrcaacata

SEQ ID NO: 13723 - DNA, 15 bp, Artificial Sequence
  Oligonucleotide probe
  misc_binding (1)..(15): Hybridization probe for the specific detection of mutant HIV-1 at codon 82 of the protease gene.
cyacaccttcaacat

SEQ ID NO: 13724 - DNA, 19 bp, Artificial Sequence
  Oligonucleotide probe
  misc_binding (1)..(19): Hybridization probe for the specific detection of mutant HIV-1 at codon 83 of the protease gene.
  modified_base (9)..(9): base is a locked nucleic acid
  modified_base (10)..(10): base is a locked nucleic acid
acacctrtcacataattgg

SEQ ID NO: 13725 - DNA, 19 bp, Artificial Sequence
  Oligonucleotide probe
  misc_binding (1)..(19): Hybridization probe for the specific detection of mutant HIV-1 at codon 83 of the protease gene.
  modified_base (5)..(5): base is a locked nucleic acid
acacctrtcacataattgg

SEQ ID NO: 13726 - DNA, 19 bp, Artificial Sequence
  Oligonucleotide probe
  misc_binding (1)..(19): Hybridization probe for the specific detection of mutant HIV-1 at codon 83 of the protease gene.
  modified_base (3)..(3): base is a locked nucleic acid
acacctrtcacataattgg

SEQ ID NO: 13727 - DNA, 19 bp, Artificial Sequence
  Oligonucleotide probe
  misc_binding (1)..(19): Hybridization probe for the specific detection of mutant HIV-1 at codon 83 of the protease gene.
  modified_base (6)..(6): base is a locked nucleic acid
acacctrtcacataattgg

SEQ ID NO: 13728 - DNA, 19 bp, Artificial Sequence
  Oligonucleotide probe
  misc_binding (1)..(19): Hybridization probe for the specific detection of mutant HIV-1 at codon 83 of the protease gene.
  modified_base (9)..(9): base is a locked nucleic acid
acacctrtcacataattgg

SEQ ID NO: 13729 - DNA, 19 bp, Artificial Sequence
  Oligonucleotide probe
  misc_binding (1)..(19): Hybridization probe for the specific detection of mutant HIV-1 at codon 83 of the protease gene.
  modified_base (15)..(15): base is a locked nucleic acid
acacctrtcacataattgg

SEQ ID NO: 13730 - DNA, 19 bp, Artificial Sequence
  Oligonucleotide probe
  misc_binding (1)..(19): Hybridization probe for the specific detection of mutant HIV-1 at codon 83 of the protease gene.
  modified_base (16)..(16): base is a locked nucleic acid
acacctrtcacataattgg

SEQ ID NO: 13731 - DNA, 19 bp, Artificial Sequence
  Oligonucleotide probe
  misc_binding (1)..(19): Hybridization probe for the specific detection of mutant HIV-1 at codon 83 of the protease gene.
  modified_base (11)..(11): base is a locked nucleic acid
acacctrtcacataattgg

SEQ ID NO: 13732 - DNA, 19 bp, Artificial Sequence
  Oligonucleotide probe
  misc_binding (1)..(19): Hybridization probe for the specific detection of mutant HIV-1 at codon 83 of the protease gene.
  modified_base (14)..(14): base is a locked nucleic acid
acacctrtcacataattgg

SEQ ID NO: 13733 - DNA, 19 bp, Artificial Sequence
  Oligonucleotide probe
  misc_binding (1)..(19): Hybridization probe for the specific detection of mutant HIV-1 at codon 83 of the protease gene.
  modified_base (3)..(3): base is a locked nucleic acid
  modified_base (9)..(9): base is a locked nucleic acid
  modified_base (10)..(10): base is a locked nucleic acid
acacctrtcacataattgg

SEQ ID NO: 13734 - DNA, 19 bp, Artificial Sequence
  Oligonucleotide probe
  misc_binding (1)..(19): Hybridization probe for the specific detection of mutant HIV-1 at codon 83 of the protease gene.
  modified_base (7)..(7): base is a locked nucleic acid
  modified_base (9)..(9): base is a locked nucleic acid
  modified_base (10)..(10): base is a locked nucleic acid
acacctrtcacataattgg

SEQ ID NO: 13735 - DNA, 19 bp, Artificial Sequence
  Oligonucleotide probe
  misc_binding (1)..(19): Hybridization probe for the specific detection of mutant HIV-1 at codon 83 of the protease gene.
  modified_base (2)..(2): base is a locked nucleic acid
  modified_base (9)..(9): base is a locked nucleic acid
  modified_base (10)..(10): base is a locked nucleic acid
acacctrtcacataattgg

SEQ ID NO: 13736 - DNA, 19 bp, Artificial Sequence
  Oligonucleotide probe
  misc_binding (1)..(19): Hybridization probe for the specific detection of mutant HIV-1 at codon 83 of the protease gene.
  modified_base (6)..(6): base is a locked nucleic acid
  modified_base (9)..(9): base is a locked nucleic acid
  modified_base (10)..(10): base is a locked nucleic acid
acacctrtcacataattgg

SEQ ID NO: 13737 - DNA, 19 bp, Artificial Sequence
  Oligonucleotide probe
  misc_binding (1)..(19): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (17)..(17): base is a locked nucleic acid
acacctrtcacataattgg

SEQ ID NO: 13738 - DNA, 19 bp, Artificial Sequence
  Oligonucleotide probe
  misc_binding (1)..(19): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (13)..(13): base is a locked nucleic acid
acacctrtcacataattgg

SEQ ID NO: 13739 - DNA, 19 bp, Artificial Sequence
  Oligonucleotide probe
  misc_binding (1)..(19): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (18)..(18): base is a locked nucleic acid
acacctrtcacataattgg

SEQ ID NO: 13740 - DNA, 19 bp, Artificial Sequence
  Oligonucleotide probe
  misc_binding (1)..(19): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (11)..(11): base is a locked nucleic acid
acacctrtcacataattgg

SEQ ID NO: 13741 - DNA, 18 bp, Artificial Sequence
  Oligonucleotide probe
  misc_binding (1)..(18): Hybridization probe for the specific detection of mutant HIV-1 at codon 83 of the protease gene.
  modified_base (9)..(9): base is a locked nucleic acid
  modified_base (10)..(10): base is a locked nucleic acid
acacctrtcacataattg

SEQ ID NO: 13742 - DNA, 18 bp, Artificial Sequence
  Oligonucleotide probe
  misc_binding (1)..(18): Hybridization probe for the specific detection of mutant HIV-1 at codon 83 of the protease gene.
  modified_base (5)..(5): base is a locked nucleic acid
acacctrtcacataattg

SEQ ID NO: 13743 - DNA, 18 bp, Artificial Sequence
  Oligonucleotide probe
  misc_binding (1)..(18): Hybridization probe for the specific detection of mutant HIV-1 at codon 83 of the protease gene.
  modified_base (3)..(3): base is a locked nucleic acid
acacctrtcacataattg

SEQ ID NO: 13744 - DNA, 18 bp, Artificial Sequence
  Oligonucleotide probe
  misc_binding (1)..(18): Hybridization probe for the specific detection of mutant HIV-1 at codon 83 of the protease gene.
  modified_base (6)..(6): base is a locked nucleic acid
acacctrtcacataattg

SEQ ID NO: 13745 - DNA, 18 bp, Artificial Sequence
  Oligonucleotide probe
  misc_binding (1)..(18): Hybridization probe for the specific detection of mutant HIV-1 at codon 83 of the protease gene.
  modified_base (9)..(9): base is a locked nucleic acid
acacctrtcacataattg

SEQ ID NO: 13746 - DNA, 18 bp, Artificial Sequence
  Oligonucleotide probe
  misc_binding (1)..(18): Hybridization probe for the specific detection of mutant HIV-1 at codon 83 of the protease gene.
  modified_base (15)..(15): base is a locked nucleic acid
acacctrtcacataattg

SEQ ID NO: 13747 - DNA, 18 bp, Artificial Sequence
  Oligonucleotide probe
  misc_binding (1)..(18): Hybridization probe for the specific detection of mutant HIV-1 at codon 83 of the protease gene.
  modified_base (16)..(16): base is a locked nucleic acid
acacctrtcacataattg

SEQ ID NO: 13748 - DNA, 18 bp, Artificial Sequence
  Oligonucleotide probe
  misc_binding (1)..(18): Hybridization probe for the specific detection of mutant HIV-1 at codon 83 of the protease gene.
  modified_base (11)..(11): base is a locked nucleic acid
acacctrtcacataattg

SEQ ID NO: 13749 - DNA, 18 bp, Artificial Sequence
  Oligonucleotide probe
  misc_binding (1)..(18): Hybridization probe for the specific detection of mutant HIV-1 at codon 83 of the protease gene.
  modified_base (14)..(14): base is a locked nucleic acid
acacctrtcacataattg

SEQ ID NO: 13750 - DNA, 18 bp, Artificial Sequence
  Oligonucleotide probe
  misc_binding (1)..(18): Hybridization probe for the specific detection of mutant HIV-1 at codon 83 of the protease gene.
  modified_base (3)..(3): base is a locked nucleic acid
  modified_base (9)..(9): base is a locked nucleic acid
  modified_base (10)..(10): base is a locked nucleic acid
acacctrtcacataattg

SEQ ID NO: 13751 - DNA, 18 bp, Artificial Sequence
  Oligonucleotide probe
  misc_binding (1)..(18): Hybridization probe for the specific detection of mutant HIV-1 at codon 83 of the protease gene.
  modified_base (7)..(7): base is a locked nucleic acid
  modified_base (9)..(9): base is a locked nucleic acid
  modified_base (10)..(10): base is a locked nucleic acid
acacctrtcacataattg

SEQ ID NO: 13752 - DNA, 18 bp, Artificial Sequence
  Oligonucleotide probe
  misc_binding (1)..(18): Hybridization probe for the specific detection of mutant HIV-1 at codon 83 of the protease gene.
  modified_base (2)..(2): base is a locked nucleic acid
  modified_base (9)..(9): base is a locked nucleic acid
  modified_base (10)..(10): base is a locked nucleic acid
acacctrtcacataattg

SEQ ID NO: 13753 - DNA, 18 bp, Artificial Sequence
  Oligonucleotide probe
  misc_binding (1)..(18): Hybridization probe for the specific detection of mutant HIV-1 at codon 83 of the protease gene.
  modified_base (6)..(6): base is a locked nucleic acid
  modified_base (9)..(9): base is a locked nucleic acid
  modified_base (10)..(10): base is a locked nucleic acid
acacctrtcacataattg

SEQ ID NO: 13754 - DNA, 18 bp, Artificial Sequence
  Oligonucleotide probe
  misc_binding (1)..(18): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (17)..(17): base is a locked nucleic acid
acacctrtcacataattg

SEQ ID NO: 13755 - DNA, 18 bp, Artificial Sequence
  Oligonucleotide probe
  misc_binding (1)..(18): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (13)..(13): base is a locked nucleic acid
acacctrtcacataattg

SEQ ID NO: 13756 - DNA, 18 bp, Artificial Sequence
  Oligonucleotide probe
  misc_binding (1)..(18): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (18)..(18): base is a locked nucleic acid
acacctrtcacataattg

SEQ ID NO: 13757 - DNA, 18 bp, Artificial Sequence
  Oligonucleotide probe
  misc_binding (1)..(18): Hybridization probe for the specific detection of mutant HIV-1 at codon 83 of the protease gene.
  modified_base (9)..(9): base is a locked nucleic acid
  modified_base (10)..(10): base is a locked nucleic acid
  modified_base (11)..(11): base is a locked nucleic acid
acacctrtcacataattg

SEQ ID NO: 13758 - DNA, 17 bp, Artificial Sequence
  Oligonucleotide probe
  misc_binding (1)..(17): Hybridization probe for the specific detection of mutant HIV-1 at codon 83 of the protease gene.
  modified_base (8)..(8): base is a locked nucleic acid
  modified_base (9)..(9): base is a locked nucleic acid
cacctrtcacataattg

SEQ ID NO: 13759 - DNA, 17 bp, Artificial Sequence
  Oligonucleotide probe
  misc_binding (1)..(17): Hybridization probe for the specific detection of mutant HIV-1 at codon 83 of the protease gene.
  modified_base (4)..(4): base is a locked nucleic acid
cacctrtcacataattg

SEQ ID NO: 13760 - DNA, 17 bp, Artificial Sequence
  Oligonucleotide probe
  misc_binding (1)..(17): Hybridization probe for the specific detection of mutant HIV-1 at codon 83 of the protease gene.
  modified_base (2)..(2): base is a locked nucleic acid
cacctrtcacataattg

SEQ ID NO: 13761 - DNA, 17 bp, Artificial Sequence
  Oligonucleotide probe
  misc_binding (1)..(17): Hybridization probe for the specific detection of mutant HIV-1 at codon 83 of the protease gene.
  modified_base (5)..(5): base is a locked nucleic acid
cacctrtcacataattg

SEQ ID NO: 13762 - DNA, 17 bp, Artificial Sequence
  Oligonucleotide probe
  misc_binding (1)..(17): Hybridization probe for the specific detection of mutant HIV-1 at codon 83 of the protease gene.
  modified_base (8)..(8): base is a locked nucleic acid
cacctrtcacataattg

SEQ ID NO: 13763 - DNA, 17 bp, Artificial Sequence
  Oligonucleotide probe
  misc_binding (1)..(17): Hybridization probe for the specific detection of mutant HIV-1 at codon 83 of the protease gene.
  modified_base (14)..(14): base is a locked nucleic acid
cacctrtcacataattg

SEQ ID NO: 13764 - DNA, 17 bp, Artificial Sequence
  Oligonucleotide probe
  misc_binding (1)..(17): Hybridization probe for the specific detection of mutant HIV-1 at codon 83 of the protease gene.
  modified_base (15)..(15): base is a locked nucleic acid
cacctrtcacataattg

SEQ ID NO: 13765 - DNA, 17 bp, Artificial Sequence
  Oligonucleotide probe
  misc_binding (1)..(17): Hybridization probe for the specific detection of mutant HIV-1 at codon 83 of the protease gene.
  modified_base (10)..(10): base is a locked nucleic acid
cacctrtcacataattg

SEQ ID NO: 13766 - DNA, 17 bp, Artificial Sequence
  Oligonucleotide probe
  misc_binding (1)..(17): Hybridization probe for the specific detection of mutant HIV-1 at codon 83 of the protease gene.
  modified_base (13)..(13): base is a locked nucleic acid
cacctrtcacataattg

SEQ ID NO: 13767 - DNA, 17 bp, Artificial Sequence
  Oligonucleotide probe
  misc_binding (1)..(17): Hybridization probe for the specific detection of mutant HIV-1 at codon 83 of the protease gene.
  modified_base (2)..(2): base is a locked nucleic acid
  modified_base (8)..(8): base is a locked nucleic acid
  modified_base (9)..(9): base is a locked nucleic acid
cacctrtcacataattg

SEQ ID NO: 13768 - DNA, 17 bp, Artificial Sequence
  Oligonucleotide probe
  misc_binding (1)..(17): Hybridization probe for the specific detection of mutant HIV-1 at codon 83 of the protease gene.
  modified_base (6)..(6): base is a locked nucleic acid
  modified_base (8)..(8): base is a locked nucleic acid
  modified_base (9)..(9): base is a locked nucleic acid
cacctrtcacataattg

SEQ ID NO: 13769 - DNA, 17 bp, Artificial Sequence
  Oligonucleotide probe
  misc_binding (1)..(17): Hybridization probe for the specific detection of mutant HIV-1 at codon 83 of the protease gene.
  modified_base (1)..(1): base is a locked nucleic acid
  modified_base (8)..(8): base is a locked nucleic acid
  modified_base (9)..(9): base is a locked nucleic acid
cacctrtcacataattg

SEQ ID NO: 13770 - DNA, 17 bp, Artificial Sequence
  Oligonucleotide probe
  misc_binding (1)..(17): Hybridization probe for the specific detection of mutant HIV-1 at codon 83 of the protease gene.
  modified_base (5)..(5): base is a locked nucleic acid
  modified_base (8)..(8): base is a locked nucleic acid
  modified_base (9)..(9): base is a locked nucleic acid
cacctrtcacataattg

SEQ ID NO: 13771 - DNA, 17 bp, Artificial Sequence
  Oligonucleotide probe
  misc_binding (1)..(17): Hybridization probe for the specific detection of mutant HIV-1 at codon 83 of the protease gene.
  modified_base (8)..(8): base is a locked nucleic acid
  modified_base (9)..(9): base is a locked nucleic acid
  modified_base (16)..(16): base is a locked nucleic acid
cacctrtcacataattg

SEQ ID NO: 13772 - DNA, 17 bp, Artificial Sequence
  Oligonucleotide probe
  misc_binding (1)..(17): Hybridization probe for the specific detection of mutant HIV-1 at codon 83 of the protease gene.
  modified_base (8)..(8): base is a locked nucleic acid
  modified_base (9)..(9): base is a locked nucleic acid
  modified_base (12)..(12): base is a locked nucleic acid
cacctrtcacataattg

SEQ ID NO: 13773 - DNA, 17 bp, Artificial Sequence
  Oligonucleotide probe
  misc_binding (1)..(17): Hybridization probe for the specific detection of mutant HIV-1 at codon 83 of the protease gene.
  modified_base (8)..(8): base is a locked nucleic acid
  modified_base (9)..(9): base is a locked nucleic acid
  modified_base (17)..(17): base is a locked nucleic acid
cacctrtcacataattg

SEQ ID NO: 13774 - DNA, 17 bp, Artificial Sequence
  Oligonucleotide probe
  misc_binding (1)..(17): Hybridization probe for the specific detection of mutant HIV-1 at codon 83 of the protease gene.
  modified_base (8)..(8): base is a locked nucleic acid
  modified_base (9)..(9): base is a locked nucleic acid
  modified_base (10)..(10): base is a locked nucleic acid
cacctrtcacataattg

SEQ ID NO: 13775 - DNA, 15 bp, Artificial Sequence
  Oligonucleotide probe
  misc_binding (1)..(15): Hybridization probe for the specific detection of mutant HIV-1 at codon 83 of the protease gene.
  modified_base (8)..(8): base is a locked nucleic acid
  modified_base (9)..(9): base is a locked nucleic acid
cacctrtcacataat

SEQ ID NO: 13776 - DNA, 15 bp, Artificial Sequence
  Oligonucleotide probe
  misc_binding (1)..(15): Hybridization probe for the specific detection of mutant HIV-1 at codon 83 of the protease gene.
  modified_base (4)..(4): base is a locked nucleic acid
cacctrtcacataat

SEQ ID NO: 13777 - DNA, 15 bp, Artificial Sequence
  Oligonucleotide probe
  misc_binding (1)..(15): Hybridization probe for the specific detection of mutant HIV-1 at codon 83 of the protease gene.
  modified_base (2)..(2): base is a locked nucleic acid
cacctrtcacataat

SEQ ID NO: 13778 - DNA, 15 bp, Artificial Sequence
  Oligonucleotide probe
  misc_binding (1)..(15): Hybridization probe for the specific detection of mutant HIV-1 at codon 83 of the protease gene.
  modified_base (5)..(5): base is a locked nucleic acid
cacctrtcacataat

SEQ ID NO: 13779 - DNA, 15 bp, Artificial Sequence
  Oligonucleotide probe
  misc_binding (1)..(15): Hybridization probe for the specific detection of mutant HIV-1 at codon 83 of the protease gene.
  modified_base (8)..(8): base is a locked nucleic acid
cacctrtcacataat

SEQ ID NO: 13780 - DNA, 15 bp, Artificial Sequence
  Oligonucleotide probe
  misc_binding (1)..(15): Hybridization probe for the specific detection of mutant HIV-1 at codon 83 of the protease gene.
  modified_base (14)..(14): base is a locked nucleic acid
cacctrtcacataat

SEQ ID NO: 13781 - DNA, 15 bp, Artificial Sequence
  Oligonucleotide probe
  misc_binding (1)..(15): Hybridization probe for the specific detection of mutant HIV-1 at codon 83 of the protease gene.
  modified_base (15)..(15): base is a locked nucleic acid
cacctrtcacataat

SEQ ID NO: 13782 - DNA, 15 bp, Artificial Sequence
  Oligonucleotide probe
  misc_binding (1)..(15): Hybridization probe for the specific detection of mutant HIV-1 at codon 83 of the protease gene.
  modified_base (10)..(10): base is a locked nucleic acid
cacctrtcacataat

SEQ ID NO: 13783 - DNA, 15 bp, Artificial Sequence
  Oligonucleotide probe
  misc_binding (1)..(15): Hybridization probe for the specific detection of mutant HIV-1 at codon 83 of the protease gene.
  modified_base (13)..(13): base is a locked nucleic acid
cacctrtcacataat

SEQ ID NO: 13784 - DNA, 15 bp, Artificial Sequence
  Oligonucleotide probe
  misc_binding (1)..(15): Hybridization probe for the specific detection of mutant HIV-1 at codon 83 of the protease gene.
  modified_base (2)..(2): base is a locked nucleic acid
  modified_base (8)..(8): base is a locked nucleic acid
  modified_base (9)..(9): base is a locked nucleic acid
cacctrtcacataat

SEQ ID NO: 13785 - DNA, 15 bp, Artificial Sequence
  Oligonucleotide probe
  misc_binding (1)..(15): Hybridization probe for the specific detection of mutant HIV-1 at codon 83 of the protease gene.
  modified_base (6)..(6): base is a locked nucleic acid
  modified_base (8)..(8): base is a locked nucleic acid
  modified_base (9)..(9): base is a locked nucleic acid
cacctrtcacataat

SEQ ID NO: 13786 - DNA, 15 bp, Artificial Sequence
  Oligonucleotide probe
  misc_binding (1)..(15): Hybridization probe for the specific detection of mutant HIV-1 at codon 83 of the protease gene.
  modified_base (1)..(1): base is a locked nucleic acid
  modified_base (8)..(8): base is a locked nucleic acid
  modified_base (9)..(9): base is a locked nucleic acid
cacctrtcacataat

SEQ ID NO: 13787 - DNA, 15 bp, Artificial Sequence
  Oligonucleotide probe
  misc_binding (1)..(15): Hybridization probe for the specific detection of mutant HIV-1 at codon 83 of the protease gene.
  modified_base (5)..(5): base is a locked nucleic acid
  modified_base (8)..(8): base is a locked nucleic acid
  modified_base (9)..(9): base is a locked nucleic acid
cacctrtcacataat

SEQ ID NO: 13788 - DNA, 15 bp, Artificial Sequence
  Oligonucleotide probe
  misc_binding (1)..(15): Hybridization probe for the specific detection of mutant HIV-1 at codon 83 of the protease gene.
  modified_base (8)..(8): base is a locked nucleic acid
  modified_base (9)..(9): base is a locked nucleic acid
cacctrtcacataat

SEQ ID NO: 13789 - DNA, 15 bp, Artificial Sequence
  Oligonucleotide probe
  misc_binding (1)..(15): Hybridization probe for the specific detection of mutant HIV-1 at codon 83 of the protease gene.
  modified_base (8)..(8): base is a locked nucleic acid
  modified_base (9)..(9): base is a locked nucleic acid
  modified_base (12)..(12): base is a locked nucleic acid
cacctrtcacataat

SEQ ID NO: 13790 - DNA, 16 bp, Artificial Sequence
  Oligonucleotide probe
  misc_binding (1)..(16): Hybridization probe for the specific detection of mutant HIV-1 at codon 83 of the protease gene.
  modified_base (8)..(8): base is a locked nucleic acid
  modified_base (9)..(9): base is a locked nucleic acid
cacctrtcacataatt

SEQ ID NO: 13791 - DNA, 15 bp, Artificial Sequence
  Oligonucleotide probe
  misc_binding (1)..(15): Hybridization probe for the specific detection of mutant HIV-1 at codon 83 of the protease gene.
  modified_base (8)..(8): base is a locked nucleic acid
  modified_base (9)..(9): base is a locked nucleic acid
  modified_base (10)..(10): base is a locked nucleic acid
cacctrtcacataat

SEQ ID NO: 13792 - DNA, 15 bp, Artificial Sequence
  Oligonucleotide probe
  misc_binding (1)..(15): Hybridization probe for the specific detection of mutant HIV-1 at codon 83 of the protease gene.
acctgtcgayataat

SEQ ID NO: 13793 - DNA, 19 bp, Artificial Sequence
  Oligonucleotide probe
  misc_binding (1)..(19): Hybridization probe for the specific detection of mutant HIV-1 at codon 83 of the protease gene.
acacctrtcacataattgg

SEQ ID NO: 13794 - DNA, 18 bp, Artificial Sequence
  Oligonucleotide probe
  misc_binding (1)..(18): Hybridization probe for the specific detection of mutant HIV-1 at codon 83 of the protease gene.
acacctrtcacataattg

SEQ ID NO: 13795 - DNA, 17 bp, Artificial Sequence
  Oligonucleotide probe
  misc_binding (1)..(17): Hybridization probe for the specific detection of mutant HIV-1 at codon 83 of the protease gene.
cacctrtcacataattg

SEQ ID NO: 13796 - DNA, 15 bp, Artificial Sequence
  Oligonucleotide probe
  misc_binding (1)..(15): Hybridization probe for the specific detection of mutant HIV-1 at codon 83 of the protease gene.
cacctrtcacataat

SEQ ID NO: 13797 - DNA, 16 bp, Artificial Sequence
  Oligonucleotide probe
  misc_binding (1)..(16): Hybridization probe for the specific detection of mutant HIV-1 at codon 83 of the protease gene.
cacctrtcacataatt

SEQ ID NO: 13798 - DNA, 19 bp, Artificial Sequence
  Oligonucleotide probe
  misc_binding (1)..(19): Hybridization probe for the specific detection of mutant HIV-1 at codon 84 of the protease gene.
  modified_base (9)..(9): base is a locked nucleic acid
  modified_base (10)..(10): base is a locked nucleic acid
cctrtcaactaattggrmg

SEQ ID NO: 13799 - DNA, 19 bp, Artificial Sequence
  Oligonucleotide probe
  misc_binding (1)..(19): Hybridization probe for the specific detection of mutant HIV-1 at codon 84 of the protease gene.
  modified_base (2)..(2): base is a locked nucleic acid
cctrtcaactaattggrmg

SEQ ID NO: 13800 - DNA, 19 bp, Artificial Sequence
  Oligonucleotide probe
  misc_binding (1)..(19): Hybridization probe for the specific detection of mutant HIV-1 at codon 84 of the protease gene.
  modified_base (3)..(3): base is a locked nucleic acid
cctrtcaactaattggrmg

SEQ ID NO: 13801 - DNA, 19 bp, Artificial Sequence
  Oligonucleotide probe
  misc_binding (1)..(19): Hybridization probe for the specific detection of mutant HIV-1 at codon 84 of the protease gene.
  modified_base (9)..(9): base is a locked nucleic acid
cctrtcaactaattggrmg

SEQ ID NO: 13802 - DNA, 19 bp, Artificial Sequence
  Oligonucleotide probe
  misc_binding (1)..(19): Hybridization probe for the specific detection of mutant HIV-1 at codon 84 of the protease gene.
  modified_base (5)..(5): base is a locked nucleic acid
cctrtcaactaattggrmg

SEQ ID NO: 13803 - DNA, 19 bp, Artificial Sequence
  Oligonucleotide probe
  misc_binding (1)..(19): Hybridization probe for the specific detection of mutant HIV-1 at codon 84 of the protease gene.
  modified_base (14)..(14): base is a locked nucleic acid
cctrtcaactaattggrmg

SEQ ID NO: 13804 - DNA, 19 bp, Artificial Sequence
  Oligonucleotide probe
  misc_binding (1)..(19): Hybridization probe for the specific detection of mutant HIV-1 at codon 84 of the protease gene.
  modified_base (18)..(18): base is a locked nucleic acid
cctrtcaactaattggrmg

SEQ ID NO: 13805 - DNA, 19 bp, Artificial Sequence
  Oligonucleotide probe
  misc_binding (1)..(19): Hybridization probe for the specific detection of mutant HIV-1 at codon 84 of the protease gene.
  modified_base (11)..(11): base is a locked nucleic acid
cctrtcaactaattggrmg

SEQ ID NO: 13806 - DNA, 19 bp, Artificial Sequence
  Oligonucleotide probe
  misc_binding (1)..(19): Hybridization probe for the specific detection of mutant HIV-1 at codon 84 of the protease gene.
  modified_base (12)..(12): base is a locked nucleic acid
cctrtcaactaattggrmg

SEQ ID NO: 13807 - DNA, 19 bp, Artificial Sequence
  Oligonucleotide probe
  misc_binding (1)..(19): Hybridization probe for the specific detection of mutant HIV-1 at codon 84 of the protease gene.
  modified_base (7)..(7): base is a locked nucleic acid
  modified_base (9)..(9): base is a locked nucleic acid
  modified_base (10)..(10): base is a locked nucleic acid
cctrtcaactaattggrmg

SEQ ID NO: 13808 - DNA, 19 bp, Artificial Sequence
  Oligonucleotide probe
  misc_binding (1)..(19): Hybridization probe for the specific detection of mutant HIV-1 at codon 84 of the protease gene.
  modified_base (6)..(6): base is a locked nucleic acid
  modified_base (9)..(9): base is a locked nucleic acid
  modified_base (10)..(10): base is a locked nucleic acid
cctrtcaactaattggrmg

SEQ ID NO: 13809 - DNA, 19 bp, Artificial Sequence
  Oligonucleotide probe
  misc_binding (1)..(19): Hybridization probe for the specific detection of mutant HIV-1 at codon 84 of the protease gene.
  modified_base (3)..(3): base is a locked nucleic acid
  modified_base (9)..(9): base is a locked nucleic acid
  modified_base (10)..(10): base is a locked nucleic acid
cctrtcaactaattggrmg

SEQ ID NO: 13810 - DNA, 19 bp, Artificial Sequence
  Oligonucleotide probe
  misc_binding (1)..(19): Hybridization probe for the specific detection of mutant HIV-1 at codon 84 of the protease gene.
  modified_base (5)..(5): base is a locked nucleic acid
  modified_base (9)..(9): base is a locked nucleic acid
  modified_base (10)..(10): base is a locked nucleic acid
cctrtcaactaattggrmg

SEQ ID NO: 13811 - DNA, 19 bp, Artificial Sequence
  Oligonucleotide probe
  misc_binding (1)..(19): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (16)..(16): base is a locked nucleic acid
cctrtcaactaattggrmg

SEQ ID NO: 13812 - DNA, 19 bp, Artificial Sequence
  Oligonucleotide probe
  misc_binding (1)..(19): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (11)..(11): base is a locked nucleic acid
cctrtcaactaattggrmg

SEQ ID NO: 13813 - DNA, 19 bp, Artificial Sequence
  Oligonucleotide probe
  misc_binding (1)..(19): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (14)..(14): base is a locked nucleic acid
cctrtcaactaattggrmg

SEQ ID NO: 13814 - DNA, 19 bp, Artificial Sequence
  Oligonucleotide probe
  misc_binding (1)..(19): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (18)..(18): base is a locked nucleic acid
cctrtcaactaattggrmg

SEQ ID NO: 13815 - DNA, 18 bp, Artificial Sequence
  Oligonucleotide probe
  misc_binding (1)..(18): Hybridization probe for the specific detection of mutant HIV-1 at codon 84 of the protease gene.
  modified_base (9)..(9): base is a locked nucleic acid
  modified_base (10)..(10): base is a locked nucleic acid
cctrtcaactaattggrm

SEQ ID NO: 13816 - DNA, 18 bp, Artificial Sequence
  Oligonucleotide probe
  misc_binding (1)..(18): Hybridization probe for the specific detection of mutant HIV-1 at codon 84 of the protease gene.
  modified_base (2)..(2): base is a locked nucleic acid
cctrtcaactaattggrm

SEQ ID NO: 13817 - DNA, 18 bp, Artificial Sequence
  Oligonucleotide probe
  misc_binding (1)..(18): Hybridization probe for the specific detection of mutant HIV-1 at codon 84 of the protease gene.
  modified_base (3)..(3): base is a locked nucleic acid
cctrtcaactaattggrm

SEQ ID NO: 13818 - DNA, 18 bp, Artificial Sequence
  Oligonucleotide probe
  misc_binding (1)..(18): Hybridization probe for the specific detection of mutant HIV-1 at codon 84 of the protease gene.
  modified_base (9)..(9): base is a locked nucleic acid
cctrtcaactaattggrm

SEQ ID NO: 13819 - DNA, 18 bp, Artificial Sequence
  Oligonucleotide probe
  misc_binding (1)..(18): Hybridization probe for the specific detection of mutant HIV-1 at codon 84 of the protease gene.
  modified_base (5)..(5): base is a locked nucleic acid
cctrtcaactaattggrm

SEQ ID NO: 13820 - DNA, 18 bp, Artificial Sequence
  Oligonucleotide probe
  misc_binding (1)..(18): Hybridization probe for the specific detection of mutant HIV-1 at codon 84 of the protease gene.
  modified_base (14)..(14): base is a locked nucleic acid
cctrtcaactaattggrm

SEQ ID NO: 13821 - DNA, 18 bp, Artificial Sequence
  Oligonucleotide probe
  misc_binding (1)..(18): Hybridization probe for the specific detection of mutant HIV-1 at codon 84 of the protease gene.
  modified_base (18)..(18): base is a locked nucleic acid
cctrtcaactaattggrm

SEQ ID NO: 13822 - DNA, 18 bp, Artificial Sequence
  Oligonucleotide probe
  misc_binding (1)..(18): Hybridization probe for the specific detection of mutant HIV-1 at codon 84 of the protease gene.
  modified_base (11)..(11): base is a locked nucleic acid
cctrtcaactaattggrm

SEQ ID NO: 13823 - DNA, 18 bp, Artificial Sequence
  Oligonucleotide probe
  misc_binding (1)..(18): Hybridization probe for the specific detection of mutant HIV-1 at codon 84 of the protease gene.
  modified_base (12)..(12): base is a locked nucleic acid
cctrtcaactaattggrm

SEQ ID NO: 13824 - DNA, 18 bp, Artificial Sequence
  Oligonucleotide probe
  misc_binding (1)..(18): Hybridization probe for the specific detection of mutant HIV-1 at codon 84 of the protease gene.
  modified_base (7)..(7): base is a locked nucleic acid
  modified_base (9)..(9): base is a locked nucleic acid
  modified_base (10)..(10): base is a locked nucleic acid
cctrtcaactaattggrm

SEQ ID NO: 13825 - DNA, 18 bp, Artificial Sequence
  Oligonucleotide probe
  misc_binding (1)..(18): Hybridization probe for the specific detection of mutant HIV-1 at codon 84 of the protease gene.
  modified_base (6)..(6): base is a locked nucleic acid
  modified_base (9)..(9): base is a locked nucleic acid
  modified_base (10)..(10): base is a locked nucleic acid
cctrtcaactaattggrm

SEQ ID NO: 13826 - DNA, 18 bp, Artificial Sequence
  Oligonucleotide probe
  misc_binding (1)..(18): Hybridization probe for the specific detection of mutant HIV-1 at codon 84 of the protease gene.
  modified_base (3)..(3): base is a locked nucleic acid
  modified_base (9)..(9): base is a locked nucleic acid
  modified_base (10)..(10): base is a locked nucleic acid
cctrtcaactaattggrm

SEQ ID NO: 13827 - DNA, 18 bp, Artificial Sequence
  Oligonucleotide probe
  misc_binding (1)..(18): Hybridization probe for the specific detection of mutant HIV-1 at codon 84 of the protease gene.
  modified_base (5)..(5): base is a locked nucleic acid
  modified_base (9)..(9): base is a locked nucleic acid
  modified_base (10)..(10): base is a locked nucleic acid
cctrtcaactaattggrm

SEQ ID NO: 13828 - DNA, 18 bp, Artificial Sequence
  Oligonucleotide probe
  misc_binding (1)..(18): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (16)..(16): base is a locked nucleic acid
cctrtcaactaattggrm

SEQ ID NO: 13829 - DNA, 18 bp, Artificial Sequence
  Oligonucleotide probe
  misc_binding (1)..(18): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (11)..(11): base is a locked nucleic acid
cctrtcaactaattggrm

SEQ ID NO: 13830 - DNA, 18 bp, Artificial Sequence
  Oligonucleotide probe
  misc_binding (1)..(18): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (14)..(14): base is a locked nucleic acid
cctrtcaactaattggrm

SEQ ID NO: 13831 - DNA, 18 bp, Artificial Sequence
  Oligonucleotide probe
  misc_binding (1)..(18): Hybridization probe for the specific detection of mutant HIV-1 at codon 84 of the protease gene.
  modified_base (9)..(9): base is a locked nucleic acid
  modified_base (10)..(10): base is a locked nucleic acid
  modified_base (18)..(18): base is a locked nucleic acid
cctrtcaactaattggrm

SEQ ID NO: 13832 - DNA, 17 bp, Artificial Sequence
  Oligonucleotide probe
  misc_binding (1)..(17): Hybridization probe for the specific detection of mutant HIV-1 at codon 84 of the protease gene.
  modified_base (8)..(8): base is a locked nucleic acid
  modified_base (9)..(9): base is a locked nucleic acid
ctrtcaactaattggrm

SEQ ID NO: 13833 - DNA, 17 bp, Artificial Sequence
  Oligonucleotide probe
  misc_binding (1)..(17): Hybridization probe for the specific detection of mutant HIV-1 at codon 84 of the protease gene.
  modified_base (1)..(1): base is a locked nucleic acid
ctrtcaactaattggrm

SEQ ID NO: 13834 - DNA, 17 bp, Artificial Sequence
  Oligonucleotide probe
  misc_binding (1)..(17): Hybridization probe for the specific detection of mutant HIV-1 at codon 84 of the protease gene.
  modified_base (2)..(2): base is a locked nucleic acid
ctrtcaactaattggrm

SEQ ID NO: 13835 - DNA, 17 bp, Artificial Sequence
  Oligonucleotide probe
  misc_binding (1)..(17): Hybridization probe for the specific detection of mutant HIV-1 at codon 84 of the protease gene.
  modified_base (8)..(8): base is a locked nucleic acid
ctrtcaactaattggrm

SEQ ID NO: 13836 - DNA, 17 bp, Artificial Sequence
  Oligonucleotide probe
  misc_binding (1)..(17): Hybridization probe for the specific detection of mutant HIV-1 at codon 84 of the protease gene.
  modified_base (4)..(4): base is a locked nucleic acid
ctrtcaactaattggrm

SEQ ID NO: 13837 - DNA, 17 bp, Artificial Sequence
  Oligonucleotide probe
  misc_binding (1)..(17): Hybridization probe for the specific detection of mutant HIV-1 at codon 84 of the protease gene.
  modified_base (13)..(13): base is a locked nucleic acid
ctrtcaactaattggrm

SEQ ID NO: 13838 - DNA, 17 bp, Artificial Sequence
  Oligonucleotide probe
  misc_binding (1)..(17): Hybridization probe for the specific detection of mutant HIV-1 at codon 84 of the protease gene.
  modified_base (17)..(17): base is a locked nucleic acid
ctrtcaactaattggrm

SEQ ID NO: 13839 - DNA, 17 bp, Artificial Sequence
  Oligonucleotide probe
  misc_binding (1)..(17): Hybridization probe for the specific detection of mutant HIV-1 at codon 84 of the protease gene.
  modified_base (10)..(10): base is a locked nucleic acid
ctrtcaactaattggrm

SEQ ID NO: 13840 - DNA, 17 bp, Artificial Sequence
  Oligonucleotide probe
  misc_binding (1)..(17): Hybridization probe for the specific detection of mutant HIV-1 at codon 84 of the protease gene.
  modified_base (11)..(11): base is a locked nucleic acid
ctrtcaactaattggrm

SEQ ID NO: 13841 - DNA, 17 bp, Artificial Sequence
  Oligonucleotide probe
  misc_binding (1)..(17): Hybridization probe for the specific detection of mutant HIV-1 at codon 84 of the protease gene.
  modified_base (6)..(6): base is a locked nucleic acid
  modified_base (8)..(8): base is a locked nucleic acid
  modified_base (9)..(9): base is a locked nucleic acid
ctrtcaactaattggrm

SEQ ID NO: 13842 - DNA, 17 bp, Artificial Sequence
  Oligonucleotide probe
  misc_binding (1)..(17): Hybridization probe for the specific detection of mutant HIV-1 at codon 84 of the protease gene.
  modified_base (5)..(5): base is a locked nucleic acid
  modified_base (8)..(8): base is a locked nucleic acid
  modified_base (9)..(9): base is a locked nucleic acid
ctrtcaactaattggrm

SEQ ID NO: 13843 - DNA, 17 bp, Artificial Sequence
  Oligonucleotide probe
  misc_binding (1)..(17): Hybridization probe for the specific detection of mutant HIV-1 at codon 84 of the protease gene.
  modified_base (2)..(2): base is a locked nucleic acid
  modified_base (8)..(8): base is a locked nucleic acid
  modified_base (9)..(9): base is a locked nucleic acid
ctrtcaactaattggrm

SEQ ID NO: 13844 - DNA, 17 bp, Artificial Sequence
  Oligonucleotide probe
  misc_binding (1)..(17): Hybridization probe for the specific detection of mutant HIV-1 at codon 84 of the protease gene.
  modified_base (4)..(4): base is a locked nucleic acid
  modified_base (8)..(8): base is a locked nucleic acid
  modified_base (9)..(9): base is a locked nucleic acid
ctrtcaactaattggrm

SEQ ID NO: 13845 - DNA, 17 bp, Artificial Sequence
  Oligonucleotide probe
  misc_binding (1)..(17): Hybridization probe for the specific detection of mutant HIV-1 at codon 84 of the protease gene.
  modified_base (8)..(8): base is a locked nucleic acid
  modified_base (9)..(9): base is a locked nucleic acid
  modified_base (15)..(15): base is a locked nucleic acid
ctrtcaactaattggrm

SEQ ID NO: 13846 - DNA, 17 bp, Artificial Sequence
  Oligonucleotide probe
  misc_binding (1)..(17): Hybridization probe for the specific detection of mutant HIV-1 at codon 84 of the protease gene.
  modified_base (8)..(8): base is a locked nucleic acid
  modified_base (9)..(9): base is a locked nucleic acid
  modified_base (10)..(10): base is a locked nucleic acid
ctrtcaactaattggrm

SEQ ID NO: 13847 - DNA, 17 bp, Artificial Sequence
  Oligonucleotide probe
  misc_binding (1)..(17): Hybridization probe for the specific detection of mutant HIV-1 at codon 84 of the protease gene.
  modified_base (8)..(8): base is a locked nucleic acid
  modified_base (9)..(9): base is a locked nucleic acid
  modified_base (13)..(13): base is a locked nucleic acid
ctrtcaactaattggrm

SEQ ID NO: 13848 - DNA, 17 bp, Artificial Sequence
  Oligonucleotide probe
  misc_binding (1)..(17): Hybridization probe for the specific detection of mutant HIV-1 at codon 84 of the protease gene.
  modified_base (8)..(8): base is a locked nucleic acid
  modified_base (9)..(9): base is a locked nucleic acid
  modified_base (17)..(17): base is a locked nucleic acid
ctrtcaactaattggrm

SEQ ID NO: 13849 - DNA, 15 bp, Artificial Sequence
  Oligonucleotide probe
  misc_binding (1)..(15): Hybridization probe for the specific detection of mutant HIV-1 at codon 84 of the protease gene.
  modified_base (8)..(8): base is a locked nucleic acid
  modified_base (9)..(9): base is a locked nucleic acid
ctrtcaactaattgg

SEQ ID NO: 13850 - DNA, 15 bp, Artificial Sequence
  Oligonucleotide probe
  misc_binding (1)..(15): Hybridization probe for the specific detection of mutant HIV-1 at codon 84 of the protease gene.
  modified_base (1)..(1): base is a locked nucleic acid
ctrtcaactaattgg

SEQ ID NO: 13851 - DNA, 15 bp, Artificial Sequence
  Oligonucleotide probe
  misc_binding (1)..(15): Hybridization probe for the specific detection of mutant HIV-1 at codon 84 of the protease gene.
  modified_base (2)..(2): base is a locked nucleic acid
ctrtcaactaattgg

SEQ ID NO: 13852 - DNA, 15 bp, Artificial Sequence
  Oligonucleotide probe
  misc_binding (1)..(15): Hybridization probe for the specific detection of mutant HIV-1 at codon 84 of the protease gene.
  modified_base (8)..(8): base is a locked nucleic acid
ctrtcaactaattgg

SEQ ID NO: 13853 - DNA, 15 bp, Artificial Sequence
  Oligonucleotide probe
  misc_binding (1)..(15): Hybridization probe for the specific detection of mutant HIV-1 at codon 84 of the protease gene.
  modified_base (4)..(4): base is a locked nucleic acid
ctrtcaactaattgg

SEQ ID NO: 13854 - DNA, 15 bp, Artificial Sequence
  Oligonucleotide probe
  misc_binding (1)..(15): Hybridization probe for the specific detection of mutant HIV-1 at codon 84 of the protease gene.
  modified_base (13)..(13): base is a locked nucleic acid
ctrtcaactaattgg

SEQ ID NO: 13855 - DNA, 16 bp, Artificial Sequence
  Oligonucleotide probe
  misc_binding (1)..(16): Hybridization probe for the specific detection of mutant HIV-1 at codon 84 of the protease gene.
ctrtcaactaattggr

SEQ ID NO: 13856 - DNA, 15 bp, Artificial Sequence
  Oligonucleotide probe
  misc_binding (1)..(15): Hybridization probe for the specific detection of mutant HIV-1 at codon 84 of the protease gene.
  modified_base (10)..(10): base is a locked nucleic acid
ctrtcaactaattgg

SEQ ID NO: 13857 - DNA, 15 bp, Artificial Sequence
  Oligonucleotide probe
  misc_binding (1)..(15): Hybridization probe for the specific detection of mutant HIV-1 at codon 84 of the protease gene.
  modified_base (11)..(11): base is a locked nucleic acid
ctrtcaactaattgg

SEQ ID NO: 13858 - DNA, 15 bp, Artificial Sequence
  Oligonucleotide probe
  misc_binding (1)..(15): Hybridization probe for the specific detection of mutant HIV-1 at codon 84 of the protease gene.
  modified_base (6)..(6): base is a locked nucleic acid
  modified_base (8)..(8): base is a locked nucleic acid
  modified_base (9)..(9): base is a locked nucleic acid
ctrtcaactaattgg

SEQ ID NO: 13859 - DNA, 15 bp, Artificial Sequence
  Oligonucleotide probe
  misc_binding (1)..(15): Hybridization probe for the specific detection of mutant HIV-1 at codon 84 of the protease gene.
  modified_base (5)..(5): base is a locked nucleic acid
  modified_base (8)..(8): base is a locked nucleic acid
  modified_base (9)..(9): base is a locked nucleic acid
ctrtcaactaattgg

SEQ ID NO: 13860 - DNA, 15 bp, Artificial Sequence
  Oligonucleotide probe
  misc_binding (1)..(15): Hybridization probe for the specific detection of mutant HIV-1 at codon 84 of the protease gene.
  modified_base (2)..(2): base is a locked nucleic acid
  modified_base (8)..(8): base is a locked nucleic acid
  modified_base (9)..(9): base is a locked nucleic acid
ctrtcaactaattgg

SEQ ID NO: 13861 - DNA, 15 bp, Artificial Sequence
  Oligonucleotide probe
  misc_binding (1)..(15): Hybridization probe for the specific detection of mutant HIV-1 at codon 84 of the protease gene.
  modified_base (4)..(4): base is a locked nucleic acid
  modified_base (8)..(8): base is a locked nucleic acid
  modified_base (9)..(9): base is a locked nucleic acid
ctrtcaactaattgg

SEQ ID NO: 13862 - DNA, 15 bp, Artificial Sequence
  Oligonucleotide probe
  misc_binding (1)..(15): Hybridization probe for the specific detection of mutant HIV-1 at codon 84 of the protease gene.
  modified_base (8)..(8): base is a locked nucleic acid
  modified_base (9)..(9): base is a locked nucleic acid
  modified_base (15)..(15): base is a locked nucleic acid
ctrtcaactaattgg

SEQ ID NO: 13863 - DNA, 15 bp, Artificial Sequence
  Oligonucleotide probe
  misc_binding (1)..(15): Hybridization probe for the specific detection of mutant HIV-1 at codon 84 of the protease gene.
  modified_base (8)..(8): base is a locked nucleic acid
  modified_base (9)..(9): base is a locked nucleic acid
  modified_base (10)..(10): base is a locked nucleic acid
ctrtcaactaattgg

SEQ ID NO: 13864 - DNA, 15 bp, Artificial Sequence
  Oligonucleotide probe
  misc_binding (1)..(15): Hybridization probe for the specific detection of mutant HIV-1 at codon 84 of the protease gene.
  modified_base (8)..(8): base is a locked nucleic acid
  modified_base (9)..(9): base is a locked nucleic acid
  modified_base (13)..(13): base is a locked nucleic acid
ctrtcaactaattgg

SEQ ID NO: 13865 - DNA, 16 bp, Artificial Sequence
  Oligonucleotide probe
  misc_binding (1)..(16): Hybridization probe for the specific detection of mutant HIV-1 at codon 84 of the protease gene.
  modified_base (8)..(8): base is a locked nucleic acid
  modified_base (9)..(9): base is a locked nucleic acid
ctrtcaactaattggr

SEQ ID NO: 13866 - DNA, 15 bp, Artificial Sequence
  Oligonucleotide probe
  misc_binding (1)..(15): Hybridization probe for the specific detection of mutant HIV-1 at codon 84 of the protease gene.
tccaattacgttgac

SEQ ID NO: 13867 - DNA, 15 bp, Artificial Sequence
  Oligonucleotide probe
  misc_binding (1)..(15): Hybridization probe for the specific detection of mutant HIV-1 at codon 84 of the protease gene.
tccaattgcgttgac

SEQ ID NO: 13868 - DNA, 15 bp, Artificial Sequence
  Oligonucleotide probe
  misc_binding (1)..(15): Hybridization probe for the specific detection of mutant HIV-1 at codon 84 of the protease gene.
tccaatrcagttgac

SEQ ID NO: 13869 - DNA, 19 bp, Artificial Sequence
  Oligonucleotide probe
  misc_binding (1)..(19): Hybridization probe for the specific detection of mutant HIV-1 at codon 84 of the protease gene.
cctrtcaactaattggrmg

SEQ ID NO: 13870 - DNA, 18 bp, Artificial Sequence
  Oligonucleotide probe
  misc_binding (1)..(18): Hybridization probe for the specific detection of mutant HIV-1 at codon 84 of the protease gene.
cctrtcaactaattggrm

SEQ ID NO: 13871 - DNA, 17 bp, Artificial Sequence
  Oligonucleotide probe
  misc_binding (1)..(17): Hybridization probe for the specific detection of mutant HIV-1 at codon 84 of the protease gene.
ctrtcaactaattggrm

SEQ ID NO: 13872 - DNA, 15 bp, Artificial Sequence
  Oligonucleotide probe
  misc_binding (1)..(15): Hybridization probe for the specific detection of mutant HIV-1 at codon 84 of the protease gene.
ctrtcaactaattgg

SEQ ID NO: 13873 - DNA, 19 bp, Artificial Sequence
  Oligonucleotide probe
  misc_binding (1)..(19): Hybridization probe for the specific detection of mutant HIV-1 at codon 88 of the protease gene.
  modified_base (9)..(9): base is a locked nucleic acid
  modified_base (10)..(10): base is a locked nucleic acid
ttggrmgrayhtgttgacy

SEQ ID NO: 13874 - DNA, 19 bp, Artificial Sequence
  Oligonucleotide probe
  misc_binding (1)..(19): Hybridization probe for the specific detection of mutant HIV-1 at codon 88 of the protease gene.
  modified_base (2)..(2): base is a locked nucleic acid
ttggrmgrayhtgttgacy

SEQ ID NO: 13875 - DNA, 19 bp, Artificial Sequence
  Oligonucleotide probe
  misc_binding (1)..(19): Hybridization probe for the specific detection of mutant HIV-1 at codon 88 of the protease gene.
  modified_base (5)..(5): base is a locked nucleic acid
ttggrmgrayhtgttgacy

SEQ ID NO: 13876 - DNA, 19 bp, Artificial Sequence
  Oligonucleotide probe
  misc_binding (1)..(19): Hybridization probe for the specific detection of mutant HIV-1 at codon 88 of the protease gene.
  modified_base (4)..(4): base is a locked nucleic acid
ttggrmgrayhtgttgacy

SEQ ID NO: 13877 - DNA, 19 bp, Artificial Sequence
  Oligonucleotide probe
  misc_binding (1)..(19): Hybridization probe for the specific detection of mutant HIV-1 at codon 88 of the protease gene.
  modified_base (3)..(3): base is a locked nucleic acid
ttggrmgrayhtgttgacy

SEQ ID NO: 13878 - DNA, 19 bp, Artificial Sequence
  Oligonucleotide probe
  misc_binding (1)..(19): Hybridization probe for the specific detection of mutant HIV-1 at codon 88 of the protease gene.
  modified_base (18)..(18): base is a locked nucleic acid
ttggrmgrayhtgttgacy

SEQ ID NO: 13879 - DNA, 19 bp, Artificial Sequence
  Oligonucleotide probe
  misc_binding (1)..(19): Hybridization probe for the specific detection of mutant HIV-1 at codon 88 of the protease gene.
  modified_base (16)..(16): base is a locked nucleic acid
ttggrmgrayhtgttgacy

SEQ ID NO: 13880 - DNA, 19 bp, Artificial Sequence
  Oligonucleotide probe
  misc_binding (1)..(19): Hybridization probe for the specific detection of mutant HIV-1 at codon 88 of the protease gene.
  modified_base (14)..(14): base is a locked nucleic acid
ttggrmgrayhtgttgacy

SEQ ID NO: 13881 - DNA, 19 bp, Artificial Sequence
  Oligonucleotide probe
  misc_binding (1)..(19): Hybridization probe for the specific detection of mutant HIV-1 at codon 88 of the protease gene.
  modified_base (12)..(12): base is a locked nucleic acid
ttggrmgrayhtgttgacy

SEQ ID NO: 13882 - DNA, 19 bp, Artificial Sequence
  Oligonucleotide probe
  misc_binding (1)..(19): Hybridization probe for the specific detection of mutant HIV-1 at codon 88 of the protease gene.
  modified_base (7)..(7): base is a locked nucleic acid
  modified_base (9)..(9): base is a locked nucleic acid
  modified_base (10)..(10): base is a locked nucleic acid
ttggrmgrayhtgttgacy

SEQ ID NO: 13883 - DNA, 19 bp, Artificial Sequence
  Oligonucleotide probe
  misc_binding (1)..(19): Hybridization probe for the specific detection of mutant HIV-1 at codon 88 of the protease gene.
  modified_base (3)..(3): base is a locked nucleic acid
  modified_base (9)..(9): base is a locked nucleic acid
  modified_base (10)..(10): base is a locked nucleic acid
ttggrmgrayhtgttgacy

SEQ ID NO: 13884 - DNA, 19 bp, Artificial Sequence
  Oligonucleotide probe
  misc_binding (1)..(19): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (10)..(10): base is a locked nucleic acid
ttggrmgrayhtgttgacy

SEQ ID NO: 13885 - DNA, 19 bp, Artificial Sequence
  Oligonucleotide probe
  misc_binding (1)..(19): Hybridization probe for the specific detection of mutant HIV-1 at codon 88 of the protease gene.
  modified_base (6)..(6): base is a locked nucleic acid
  modified_base (9)..(9): base is a locked nucleic acid
  modified_base (10)..(10): base is a locked nucleic acid
ttggrmgrayhtgttgacy

SEQ ID NO: 13886 - DNA, 19 bp, Artificial Sequence
  Oligonucleotide probe
  misc_binding (1)..(19): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (18)..(18): base is a locked nucleic acid
ttggrmgrayhtgttgacy

SEQ ID NO: 13887 - DNA, 19 bp, Artificial Sequence
  Oligonucleotide probe
  misc_binding (1)..(19): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (11)..(11): base is a locked nucleic acid
ttggrmgrayhtgttgacy

SEQ ID NO: 13888 - DNA, 19 bp, Artificial Sequence
  Oligonucleotide probe
  misc_binding (1)..(19): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (14)..(14): base is a locked nucleic acid
ttggrmgrayhtgttgacy

SEQ ID NO: 13889 - DNA, 19 bp, Artificial Sequence
  Oligonucleotide probe
  misc_binding (1)..(19): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (12)..(12): base is a locked nucleic acid
ttggrmgrayhtgttgacy

SEQ ID NO: 13890 - DNA, 18 bp, Artificial Sequence
  Oligonucleotide probe
  misc_binding (1)..(18): Hybridization probe for the specific detection of mutant HIV-1 at codon 88 of the protease gene.
  modified_base (9)..(9): base is a locked nucleic acid
  modified_base (10)..(10): base is a locked nucleic acid
ttggrmgrayhtgttgac

SEQ ID NO: 13891 - DNA, 18 bp, Artificial Sequence
  Oligonucleotide probe
  misc_binding (1)..(18): Hybridization probe for the specific detection of mutant HIV-1 at codon 88 of the protease gene.
  modified_base (2)..(2): base is a locked nucleic acid
ttggrmgrayhtgttgac

SEQ ID NO: 13892 - DNA, 18 bp, Artificial Sequence
  Oligonucleotide probe
  misc_binding (1)..(18): Hybridization probe for the specific detection of mutant HIV-1 at codon 88 of the protease gene.
  modified_base (5)..(5): base is a locked nucleic acid
ttggrmgrayhtgttgac

SEQ ID NO: 13893 - DNA, 18 bp, Artificial Sequence
  Oligonucleotide probe
  misc_binding (1)..(18): Hybridization probe for the specific detection of mutant HIV-1 at codon 88 of the protease gene.
  modified_base (4)..(4): base is a locked nucleic acid
ttggrmgrayhtgttgac

SEQ ID NO: 13894 - DNA, 18 bp, Artificial Sequence
  Oligonucleotide probe
  misc_binding (1)..(18): Hybridization probe for the specific detection of mutant HIV-1 at codon 88 of the protease gene.
  modified_base (3)..(3): base is a locked nucleic acid
ttggrmgrayhtgttgac

SEQ ID NO: 13895 - DNA, 18 bp, Artificial Sequence
  Oligonucleotide probe
  misc_binding (1)..(18): Hybridization probe for the specific detection of mutant HIV-1 at codon 88 of the protease gene.
  modified_base (18)..(18): base is a locked nucleic acid
ttggrmgrayhtgttgac

SEQ ID NO: 13896 - DNA, 18 bp, Artificial Sequence
  Oligonucleotide probe
  misc_binding (1)..(18): Hybridization probe for the specific detection of mutant HIV-1 at codon 88 of the protease gene.
  modified_base (16)..(16): base is a locked nucleic acid
ttggrmgrayhtgttgac

SEQ ID NO: 13897 - DNA, 18 bp, Artificial Sequence
  Oligonucleotide probe
  misc_binding (1)..(18): Hybridization probe for the specific detection of mutant HIV-1 at codon 88 of the protease gene.
  modified_base (14)..(14): base is a locked nucleic acid
ttggrmgrayhtgttgac

SEQ ID NO: 13898 - DNA, 18 bp, Artificial Sequence
  Oligonucleotide probe
  misc_binding (1)..(18): Hybridization probe for the specific detection of mutant HIV-1 at codon 88 of the protease gene.
  modified_base (12)..(12): base is a locked nucleic acid
ttggrmgrayhtgttgac

SEQ ID NO: 13899 - DNA, 18 bp, Artificial Sequence
  Oligonucleotide probe
  misc_binding (1)..(18): Hybridization probe for the specific detection of mutant HIV-1 at codon 88 of the protease gene.
  modified_base (7)..(7): base is a locked nucleic acid
  modified_base (9)..(9): base is a locked nucleic acid
  modified_base (10)..(10): base is a locked nucleic acid
ttggrmgrayhtgttgac

SEQ ID NO: 13900 - DNA, 18 bp, Artificial Sequence
  Oligonucleotide probe
  misc_binding (1)..(18): Hybridization probe for the specific detection of mutant HIV-1 at codon 88 of the protease gene.
  modified_base (3)..(3): base is a locked nucleic acid
  modified_base (9)..(9): base is a locked nucleic acid
  modified_base (10)..(10): base is a locked nucleic acid
ttggrmgrayhtgttgac

SEQ ID NO: 13901 - DNA, 18 bp, Artificial Sequence
  Oligonucleotide probe
  misc_binding (1)..(18): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (10)..(10): base is a locked nucleic acid
ttggrmgrayhtgttgac

SEQ ID NO: 13902 - DNA, 18 bp, Artificial Sequence
  Oligonucleotide probe
  misc_binding (1)..(18): Hybridization probe for the specific detection of mutant HIV-1 at codon 88 of the protease gene.
  modified_base (6)..(6): base is a locked nucleic acid
  modified_base (9)..(9): base is a locked nucleic acid
  modified_base (10)..(10): base is a locked nucleic acid
ttggrmgrayhtgttgac

SEQ ID NO: 13903 - DNA, 18 bp, Artificial Sequence
  Oligonucleotide probe
  misc_binding (1)..(18): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (18)..(18): base is a locked nucleic acid
ttggrmgrayhtgttgac

SEQ ID NO: 13904 - DNA, 18 bp, Artificial Sequence
  Oligonucleotide probe
  misc_binding (1)..(18): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (11)..(11): base is a locked nucleic acid
ttggrmgrayhtgttgac

SEQ ID NO: 13905 - DNA, 18 bp, Artificial Sequence
  Oligonucleotide probe
  misc_binding (1)..(18): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (14)..(14): base is a locked nucleic acid
ttggrmgrayhtgttgac

SEQ ID NO: 13906 - DNA, 18 bp, Artificial Sequence
  Oligonucleotide probe
  misc_binding (1)..(18): Hybridization probe for the specific detection of mutant HIV-1 at codon 88 of the protease gene.
  modified_base (9)..(9): base is a locked nucleic acid
  modified_base (10)..(10): base is a locked nucleic acid
  modified_base (12)..(12): base is a locked nucleic acid
ttggrmgrayhtgttgac

SEQ ID NO: 13907 - DNA, 17 bp, Artificial Sequence
  Oligonucleotide probe
  misc_binding (1)..(17): Hybridization probe for the specific detection of mutant HIV-1 at codon 88 of the protease gene.
  modified_base (8)..(8): base is a locked nucleic acid
  modified_base (9)..(9): base is a locked nucleic acid
tggrmgrayhtgttgac

SEQ ID NO: 13908 - DNA, 17 bp, Artificial Sequence
  Oligonucleotide probe
  misc_binding (1)..(17): Hybridization probe for the specific detection of mutant HIV-1 at codon 88 of the protease gene.
  modified_base (1)..(1): base is a locked nucleic acid
tggrmgrayhtgttgac

SEQ ID NO: 13909 - DNA, 17 bp, Artificial Sequence
  Oligonucleotide probe
  misc_binding (1)..(17): Hybridization probe for the specific detection of mutant HIV-1 at codon 88 of the protease gene.
  modified_base (4)..(4): base is a locked nucleic acid
tggrmgrayhtgttgac

SEQ ID NO: 13910 - DNA, 17 bp, Artificial Sequence
  Oligonucleotide probe
  misc_binding (1)..(17): Hybridization probe for the specific detection of mutant HIV-1 at codon 88 of the protease gene.
  modified_base (3)..(3): base is a locked nucleic acid
tggrmgrayhtgttgac

SEQ ID NO: 13911 - DNA, 17 bp, Artificial Sequence
  Oligonucleotide probe
  misc_binding (1)..(17): Hybridization probe for the specific detection of mutant HIV-1 at codon 88 of the protease gene.
  modified_base (2)..(2): base is a locked nucleic acid
tggrmgrayhtgttgac

SEQ ID NO: 13912 - DNA, 17 bp, Artificial Sequence
  Oligonucleotide probe
  misc_binding (1)..(17): Hybridization probe for the specific detection of mutant HIV-1 at codon 88 of the protease gene.
  modified_base (17)..(17): base is a locked nucleic acid
tggrmgrayhtgttgac

SEQ ID NO: 13913 - DNA, 17 bp, Artificial Sequence
  Oligonucleotide probe
  misc_binding (1)..(17): Hybridization probe for the specific detection of mutant HIV-1 at codon 88 of the protease gene.
  modified_base (15)..(15): base is a locked nucleic acid
tggrmgrayhtgttgac

SEQ ID NO: 13914 - DNA, 17 bp, Artificial Sequence
  Oligonucleotide probe
  misc_binding (1)..(17): Hybridization probe for the specific detection of mutant HIV-1 at codon 88 of the protease gene.
  modified_base (13)..(13): base is a locked nucleic acid
tggrmgrayhtgttgac

SEQ ID NO: 13915 - DNA, 17 bp, Artificial Sequence
  Oligonucleotide probe
  misc_binding (1)..(17): Hybridization probe for the specific detection of mutant HIV-1 at codon 88 of the protease gene.
  modified_base (11)..(11): base is a locked nucleic acid
tggrmgrayhtgttgac

SEQ ID NO: 13916 - DNA, 17 bp, Artificial Sequence
  Oligonucleotide probe
  misc_binding (1)..(17): Hybridization probe for the specific detection of mutant HIV-1 at codon 88 of the protease gene.
  modified_base (6)..(6): base is a locked nucleic acid
  modified_base (8)..(8): base is a locked nucleic acid
  modified_base (9)..(9): base is a locked nucleic acid
tggrmgrayhtgttgac

SEQ ID NO: 13917 - DNA, 17 bp, Artificial Sequence
  Oligonucleotide probe
  misc_binding (1)..(17): Hybridization probe for the specific detection of mutant HIV-1 at codon 88 of the protease gene.
  modified_base (2)..(2): base is a locked nucleic acid
  modified_base (8)..(8): base is a locked nucleic acid
  modified_base (9)..(9): base is a locked nucleic acid
tggrmgrayhtgttgac

SEQ ID NO: 13918 - DNA, 17 bp, Artificial Sequence
  Oligonucleotide probe
  misc_binding (1)..(17): Hybridization probe for the specific detection of mutant HIV-1 at codon 88 of the protease gene.
  modified_base (7)..(7): base is a locked nucleic acid
  modified_base (8)..(8): base is a locked nucleic acid
  modified_base (9)..(9): base is a locked nucleic acid
tggrmgrayhtgttgac

SEQ ID NO: 13919 - DNA, 17 bp, Artificial Sequence
  Oligonucleotide probe
  misc_binding (1)..(17): Hybridization probe for the specific detection of mutant HIV-1 at codon 88 of the protease gene.
  modified_base (5)..(5): base is a locked nucleic acid
  modified_base (8)..(8): base is a locked nucleic acid
  modified_base (9)..(9): base is a locked nucleic acid
tggrmgrayhtgttgac

SEQ ID NO: 13920 - DNA, 17 bp, Artificial Sequence
  Oligonucleotide probe
  misc_binding (1)..(17): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (17)..(17): base is a locked nucleic acid
tggrmgrayhtgttgac

SEQ ID NO: 13921 - DNA, 17 bp, Artificial Sequence
  Oligonucleotide probe
  misc_binding (1)..(17): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (10)..(10): base is a locked nucleic acid
tggrmgrayhtgttgac

SEQ ID NO: 13922 - DNA, 17 bp, Artificial Sequence
  Oligonucleotide probe
  misc_binding (1)..(17): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (13)..(13): base is a locked nucleic acid
tggrmgrayhtgttgac

SEQ ID NO: 13923 - DNA, 17 bp, Artificial Sequence
  Oligonucleotide probe
  misc_binding (1)..(17): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (11)..(11): base is a locked nucleic acid
tggrmgrayhtgttgac

SEQ ID NO: 13924 - DNA, 15 bp, Artificial Sequence
  Oligonucleotide probe
  misc_binding (1)..(15): Hybridization probe for the specific detection of mutant HIV-1 at codon 88 of the protease gene.
  modified_base (8)..(8): base is a locked nucleic acid
  modified_base (9)..(9): base is a locked nucleic acid
tggrmgrayhtgttg

SEQ ID NO: 13925 - DNA, 15 bp, Artificial Sequence
  Oligonucleotide probe
  misc_binding (1)..(15): Hybridization probe for the specific detection of mutant HIV-1 at codon 88 of the protease gene.
  modified_base (1)..(1): base is a locked nucleic acid
tggrmgrayhtgttg

SEQ ID NO: 13926 - DNA, 15 bp, Artificial Sequence
  Oligonucleotide probe
  misc_binding (1)..(15): Hybridization probe for the specific detection of mutant HIV-1 at codon 88 of the protease gene.
  modified_base (4)..(4): base is a locked nucleic acid
tggrmgrayhtgttg

SEQ ID NO: 13927 - DNA, 15 bp, Artificial Sequence
  Oligonucleotide probe
  misc_binding (1)..(15): Hybridization probe for the specific detection of mutant HIV-1 at codon 88 of the protease gene.
  modified_base (3)..(3): base is a locked nucleic acid
tggrmgrayhtgttg

SEQ ID NO: 13928 - DNA, 15 bp, Artificial Sequence
  Oligonucleotide probe
  misc_binding (1)..(15): Hybridization probe for the specific detection of mutant HIV-1 at codon 88 of the protease gene.
  modified_base (2)..(2): base is a locked nucleic acid
tggrmgrayhtgttg

SEQ ID NO: 13929 - DNA, 16 bp, Artificial Sequence
  Oligonucleotide probe
  misc_binding (1)..(16): Hybridization probe for the specific detection of mutant HIV-1 at codon 88 of the protease gene.
tggrmgrayhtgttga

SEQ ID NO: 13930 - DNA, 15 bp, Artificial Sequence
  Oligonucleotide probe
  misc_binding (1)..(15): Hybridization probe for the specific detection of mutant HIV-1 at codon 88 of the protease gene.
  modified_base (15)..(15): base is a locked nucleic acid
tggrmgrayhtgttg

SEQ ID NO: 13931 - DNA, 15 bp, Artificial Sequence
  Oligonucleotide probe
  misc_binding (1)..(15): Hybridization probe for the specific detection of mutant HIV-1 at codon 88 of the protease gene.
  modified_base (13)..(13): base is a locked nucleic acid
tggrmgrayhtgttg

SEQ ID NO: 13932 - DNA, 15 bp, Artificial Sequence
  Oligonucleotide probe
  misc_binding (1)..(15): Hybridization probe for the specific detection of mutant HIV-1 at codon 88 of the protease gene.
  modified_base (11)..(11): base is a locked nucleic acid
tggrmgrayhtgttg

SEQ ID NO: 13933 - DNA, 15 bp, Artificial Sequence
  Oligonucleotide probe
  misc_binding (1)..(15): Hybridization probe for the specific detection of mutant HIV-1 at codon 88 of the protease gene.
  modified_base (6)..(6): base is a locked nucleic acid
  modified_base (8)..(8): base is a locked nucleic acid
  modified_base (9)..(9): base is a locked nucleic acid
tggrmgrayhtgttg

SEQ ID NO: 13934 - DNA, 15 bp, Artificial Sequence
  Oligonucleotide probe
  misc_binding (1)..(15): Hybridization probe for the specific detection of mutant HIV-1 at codon 88 of the protease gene.
  modified_base (2)..(2): base is a locked nucleic acid
  modified_base (8)..(8): base is a locked nucleic acid
  modified_base (9)..(9): base is a locked nucleic acid
tggrmgrayhtgttg

SEQ ID NO: 13935 - DNA, 15 bp, Artificial Sequence
  Oligonucleotide probe
  misc_binding (1)..(15): Hybridization probe for the specific detection of mutant HIV-1 at codon 88 of the protease gene.
  modified_base (7)..(7): base is a locked nucleic acid
  modified_base (8)..(8): base is a locked nucleic acid
  modified_base (9)..(9): base is a locked nucleic acid
tggrmgrayhtgttg

SEQ ID NO: 13936 - DNA, 15 bp, Artificial Sequence
  Oligonucleotide probe
  misc_binding (1)..(15): Hybridization probe for the specific detection of mutant HIV-1 at codon 88 of the protease gene.
  modified_base (5)..(5): base is a locked nucleic acid
  modified_base (8)..(8): base is a locked nucleic acid
  modified_base (9)..(9): base is a locked nucleic acid
tggrmgrayhtgttg

SEQ ID NO: 13937 - DNA, 16 bp, Artificial Sequence
  Oligonucleotide probe
  misc_binding (1)..(16): Hybridization probe for the specific detection of mutant HIV-1 at codon 88 of the protease gene.
  modified_base (8)..(8): base is a locked nucleic acid
  modified_base (9)..(9): base is a locked nucleic acid
tggrmgrayhtgttga

SEQ ID NO: 13938 - DNA, 15 bp, Artificial Sequence
  Oligonucleotide probe
  misc_binding (1)..(15): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (10)..(10): base is a locked nucleic acid
tggrmgrayhtgttg

SEQ ID NO: 13939 - DNA, 15 bp, Artificial Sequence
  Oligonucleotide probe
  misc_binding (1)..(15): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (13)..(13): base is a locked nucleic acid
tggrmgrayhtgttg

SEQ ID NO: 13940 - DNA, 15 bp, Artificial Sequence
  Oligonucleotide probe
  misc_binding (1)..(15): Hybridization probe for the specific detection of mutant HIV-1 at codon 88 of the protease gene.
  modified_base (8)..(8): base is a locked nucleic acid
  modified_base (9)..(9): base is a locked nucleic acid
  modified_base (11)..(11): base is a locked nucleic acid
tggrmgrayhtgttg

SEQ ID NO: 13941 - DNA, 15 bp, Artificial Sequence
  Oligonucleotide probe
  misc_binding (1)..(15): Hybridization probe for the specific detection of mutant HIV-1 at codon 88 of the protease gene.
tggaagagayctgtt

SEQ ID NO: 13942 - DNA, 15 bp, Artificial Sequence
  Oligonucleotide probe
  misc_binding (1)..(15): Hybridization probe for the specific detection of mutant HIV-1 at codon 88 of the protease gene.
tggaagaagyctgtt

SEQ ID NO: 13943 - DNA, 15 bp, Artificial Sequence
  Oligonucleotide probe
  misc_binding (1)..(15): Hybridization probe for the specific detection of mutant HIV-1 at codon 88 of the protease gene.
tggaagaacyctgtt

SEQ ID NO: 13944 - DNA, 15 bp, Artificial Sequence
  Oligonucleotide probe
  misc_binding (1)..(15): Hybridization probe for the specific detection of mutant HIV-1 at codon 88 of the protease gene.
tggaagaggyctgtt

SEQ ID NO: 13945 - DNA, 19 bp, Artificial Sequence
  Oligonucleotide probe
  misc_binding (1)..(19): Hybridization probe for the specific detection of mutant HIV-1 at codon 88 of the protease gene.
ttggrmgrayhtgttgacy

SEQ ID NO: 13946 - DNA, 18 bp, Artificial Sequence
  Oligonucleotide probe
  misc_binding (1)..(18): Hybridization probe for the specific detection of mutant HIV-1 at codon 88 of the protease gene.
ttggrmgrayhtgttgac

SEQ ID NO: 13947 - DNA, 17 bp, Artificial Sequence
  Oligonucleotide probe
  misc_binding (1)..(17): Hybridization probe for the specific detection of mutant HIV-1 at codon 88 of the protease gene.
tggrmgrayhtgttgac

SEQ ID NO: 13948 - DNA, 15 bp, Artificial Sequence
  Oligonucleotide probe
  misc_binding (1)..(15): Hybridization probe for the specific detection of mutant HIV-1 at codon 88 of the protease gene.
tggrmgrayhtgttg

SEQ ID NO: 13949 - DNA, 19 bp, Artificial Sequence
  Oligonucleotide probe
  misc_binding (1)..(19): Hybridization probe for the specific detection of mutant HIV-1 at codon 89 of the protease gene.
  modified_base (9)..(9): base is a locked nucleic acid
  modified_base (10)..(10): base is a locked nucleic acid
ggrmgraaytgttgacyca

SEQ ID NO: 13950 - DNA, 19 bp, Artificial Sequence
  Oligonucleotide probe
  misc_binding (1)..(19): Hybridization probe for the specific detection of mutant HIV-1 at codon 89 of the protease gene.
  modified_base (2)..(2): base is a locked nucleic acid
ggrmgraaytgttgacyca

SEQ ID NO: 13951 - DNA, 19 bp, Artificial Sequence
  Oligonucleotide probe
  misc_binding (1)..(19): Hybridization probe for the specific detection of mutant HIV-1 at codon 89 of the protease gene.
  modified_base (3)..(3): base is a locked nucleic acid
ggrmgraaytgttgacyca

SEQ ID NO: 13952 - DNA, 19 bp, Artificial Sequence
  Oligonucleotide probe
  misc_binding (1)..(19): Hybridization probe for the specific detection of mutant HIV-1 at codon 89 of the protease gene.
  modified_base (9)..(9): base is a locked nucleic acid
ggrmgraaytgttgacyca

SEQ ID NO: 13953 - DNA, 19 bp, Artificial Sequence
  Oligonucleotide probe
  misc_binding (1)..(19): Hybridization probe for the specific detection of mutant HIV-1 at codon 89 of the protease gene.
  modified_base (4)..(4): base is a locked nucleic acid
ggrmgraaytgttgacyca

SEQ ID NO: 13954 - DNA, 19 bp, Artificial Sequence
  Oligonucleotide probe
  misc_binding (1)..(19): Hybridization probe for the specific detection of mutant HIV-1 at codon 89 of the protease gene.
  modified_base (18)..(18): base is a locked nucleic acid
ggrmgraaytgttgacyca

SEQ ID NO: 13955 - DNA, 19 bp, Artificial Sequence
  Oligonucleotide probe
  misc_binding (1)..(19): Hybridization probe for the specific detection of mutant HIV-1 at codon 89 of the protease gene.
  modified_base (14)..(14): base is a locked nucleic acid
ggrmgraaytgttgacyca

SEQ ID NO: 13956 - DNA, 19 bp, Artificial Sequence
  Oligonucleotide probe
  misc_binding (1)..(19): Hybridization probe for the specific detection of mutant HIV-1 at codon 89 of the protease gene.
  modified_base (13)..(13): base is a locked nucleic acid
ggrmgraaytgttgacyca

SEQ ID NO: 13957 - DNA, 19 bp, Artificial Sequence
  Oligonucleotide probe
  misc_binding (1)..(19): Hybridization probe for the specific detection of mutant HIV-1 at codon 89 of the protease gene.
  modified_base (15)..(15): base is a locked nucleic acid
ggrmgraaytgttgacyca

SEQ ID NO: 13958 - DNA, 19 bp, Artificial Sequence
  Oligonucleotide probe
  misc_binding (1)..(19): Hybridization probe for the specific detection of mutant HIV-1 at codon 89 of the protease gene.
  modified_base (3)..(3): base is a locked nucleic acid
  modified_base (9)..(9): base is a locked nucleic acid
  modified_base (10)..(10): base is a locked nucleic acid
ggrmgraaytgttgacyca

SEQ ID NO: 13959 - DNA, 19 bp, Artificial Sequence
  Oligonucleotide probe
  misc_binding (1)..(19): Hybridization probe for the specific detection of mutant HIV-1 at codon 89 of the protease gene.
  modified_base (4)..(4): base is a locked nucleic acid
  modified_base (9)..(9): base is a locked nucleic acid
  modified_base (10)..(10): base is a locked nucleic acid
ggrmgraaytgttgacyca

SEQ ID NO: 13960 - DNA, 19 bp, Artificial Sequence
  Oligonucleotide probe
  misc_binding (1)..(19): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (10)..(10): base is a locked nucleic acid
ggrmgraaytgttgacyca

SEQ ID NO: 13961 - DNA, 19 bp, Artificial Sequence
  Oligonucleotide probe
  misc_binding (1)..(19): Hybridization probe for the specific detection of mutant HIV-1 at codon 89 of the protease gene.
  modified_base (6)..(6): base is a locked nucleic acid
  modified_base (9)..(9): base is a locked nucleic acid
  modified_base (10)..(10): base is a locked nucleic acid
ggrmgraaytgttgacyca

SEQ ID NO: 13962 - DNA, 19 bp, Artificial Sequence
  Oligonucleotide probe
  misc_binding (1)..(19): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (15)..(15): base is a locked nucleic acid
ggrmgraaytgttgacyca

SEQ ID NO: 13963 - DNA, 19 bp, Artificial Sequence
  Oligonucleotide probe
  misc_binding (1)..(19): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (11)..(11): base is a locked nucleic acid
ggrmgraaytgttgacyca

SEQ ID NO: 13964 - DNA, 19 bp, Artificial Sequence
  Oligonucleotide probe
  misc_binding (1)..(19): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (14)..(14): base is a locked nucleic acid
ggrmgraaytgttgacyca

SEQ ID NO: 13965 - DNA, 19 bp, Artificial Sequence
  Oligonucleotide probe
  misc_binding (1)..(19): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (18)..(18): base is a locked nucleic acid
ggrmgraaytgttgacyca

SEQ ID NO: 13966 - DNA, 18 bp, Artificial Sequence
  Oligonucleotide probe
  misc_binding (1)..(18): Hybridization probe for the specific detection of mutant HIV-1 at codon 89 of the protease gene.
  modified_base (9)..(9): base is a locked nucleic acid
  modified_base (10)..(10): base is a locked nucleic acid
ggrmgraaytgttgacyc

SEQ ID NO: 13967 - DNA, 18 bp, Artificial Sequence
  Oligonucleotide probe
  misc_binding (1)..(18): Hybridization probe for the specific detection of mutant HIV-1 at codon 89 of the protease gene.
  modified_base (2)..(2): base is a locked nucleic acid
ggrmgraaytgttgacyc

SEQ ID NO: 13968 - DNA, 18 bp, Artificial Sequence
  Oligonucleotide probe
  misc_binding (1)..(18): Hybridization probe for the specific detection of mutant HIV-1 at codon 89 of the protease gene.
  modified_base (3)..(3): base is a locked nucleic acid
ggrmgraaytgttgacyc

SEQ ID NO: 13969 - DNA, 18 bp, Artificial Sequence
  Oligonucleotide probe
  misc_binding (1)..(18): Hybridization probe for the specific detection of mutant HIV-1 at codon 89 of the protease gene.
  modified_base (9)..(9): base is a locked nucleic acid
ggrmgraaytgttgacyc

SEQ ID NO: 13970 - DNA, 18 bp, Artificial Sequence
  Oligonucleotide probe
  misc_binding (1)..(18): Hybridization probe for the specific detection of mutant HIV-1 at codon 89 of the protease gene.
  modified_base (4)..(4): base is a locked nucleic acid
ggrmgraaytgttgacyc

SEQ ID NO: 13971 - DNA, 18 bp, Artificial Sequence
  Oligonucleotide probe
  misc_binding (1)..(18): Hybridization probe for the specific detection of mutant HIV-1 at codon 89 of the protease gene.
  modified_base (18)..(18): base is a locked nucleic acid
ggrmgraaytgttgacyc

SEQ ID NO: 13972 - DNA, 18 bp, Artificial Sequence
  Oligonucleotide probe
  misc_binding (1)..(18): Hybridization probe for the specific detection of mutant HIV-1 at codon 89 of the protease gene.
  modified_base (14)..(14): base is a locked nucleic acid
ggrmgraaytgttgacyc

SEQ ID NO: 13973 - DNA, 18 bp, Artificial Sequence
  Oligonucleotide probe
  misc_binding (1)..(18): Hybridization probe for the specific detection of mutant HIV-1 at codon 89 of the protease gene.
  modified_base (13)..(13): base is a locked nucleic acid
ggrmgraaytgttgacyc

SEQ ID NO: 13974 - DNA, 18 bp, Artificial Sequence
  Oligonucleotide probe
  misc_binding (1)..(18): Hybridization probe for the specific detection of mutant HIV-1 at codon 89 of the protease gene.
  modified_base (15)..(15): base is a locked nucleic acid
ggrmgraaytgttgacyc

SEQ ID NO: 13975 - DNA, 18 bp, Artificial Sequence
  Oligonucleotide probe
  misc_binding (1)..(18): Hybridization probe for the specific detection of mutant HIV-1 at codon 89 of the protease gene.
  modified_base (3)..(3): base is a locked nucleic acid
  modified_base (9)..(9): base is a locked nucleic acid
  modified_base (10)..(10): base is a locked nucleic acid
ggrmgraaytgttgacyc

SEQ ID NO: 13976 - DNA, 18 bp, Artificial Sequence
  Oligonucleotide probe
  misc_binding (1)..(18): Hybridization probe for the specific detection of mutant HIV-1 at codon 89 of the protease gene.
  modified_base (4)..(4): base is a locked nucleic acid
  modified_base (9)..(9): base is a locked nucleic acid
  modified_base (10)..(10): base is a locked nucleic acid
ggrmgraaytgttgacyc

SEQ ID NO: 13977 - DNA, 18 bp, Artificial Sequence
  Oligonucleotide probe
  misc_binding (1)..(18): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (10)..(10): base is a locked nucleic acid
ggrmgraaytgttgacyc

SEQ ID NO: 13978 - DNA, 18 bp, Artificial Sequence
  Oligonucleotide probe
  misc_binding (1)..(18): Hybridization probe for the specific detection of mutant HIV-1 at codon 89 of the protease gene.
  modified_base (6)..(6): base is a locked nucleic acid
  modified_base (9)..(9): base is a locked nucleic acid
  modified_base (10)..(10): base is a locked nucleic acid
ggrmgraaytgttgacyc

SEQ ID NO: 13979 - DNA, 18 bp, Artificial Sequence
  Oligonucleotide probe
  misc_binding (1)..(18): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (15)..(15): base is a locked nucleic acid
ggrmgraaytgttgacyc

SEQ ID NO: 13980 - DNA, 18 bp, Artificial Sequence
  Oligonucleotide probe
  misc_binding (1)..(18): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (11)..(11): base is a locked nucleic acid
ggrmgraaytgttgacyc

SEQ ID NO: 13981 - DNA, 18 bp, Artificial Sequence
  Oligonucleotide probe
  misc_binding (1)..(18): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (14)..(14): base is a locked nucleic acid
ggrmgraaytgttgacyc

SEQ ID NO: 13982 - DNA, 18 bp, Artificial Sequence
  Oligonucleotide probe
  misc_binding (1)..(18): Hybridization probe for the specific detection of mutant HIV-1 at codon 89 of the protease gene.
  modified_base (9)..(9): base is a locked nucleic acid
  modified_base (10)..(10): base is a locked nucleic acid
  modified_base (18)..(18): base is a locked nucleic acid
ggrmgraaytgttgacyc

SEQ ID NO: 13983 - DNA, 17 bp, Artificial Sequence
  Oligonucleotide probe
  misc_binding (1)..(17): Hybridization probe for the specific detection of mutant HIV-1 at codon 89 of the protease gene.
  modified_base (8)..(8): base is a locked nucleic acid
  modified_base (9)..(9): base is a locked nucleic acid
grmgraaytgttgacyc

SEQ ID NO: 13984 - DNA, 17 bp, Artificial Sequence
  Oligonucleotide probe
  misc_binding (1)..(17): Hybridization probe for the specific detection of mutant HIV-1 at codon 89 of the protease gene.
  modified_base (1)..(1): base is a locked nucleic acid
grmgraaytgttgacyc

SEQ ID NO: 13985 - DNA, 17 bp, Artificial Sequence
  Oligonucleotide probe
  misc_binding (1)..(17): Hybridization probe for the specific detection of mutant HIV-1 at codon 89 of the protease gene.
  modified_base (2)..(2): base is a locked nucleic acid
grmgraaytgttgacyc

SEQ ID NO: 13986 - DNA, 17 bp, Artificial Sequence
  Oligonucleotide probe
  misc_binding (1)..(17): Hybridization probe for the specific detection of mutant HIV-1 at codon 89 of the protease gene.
  modified_base (8)..(8): base is a locked nucleic acid
grmgraaytgttgacyc

SEQ ID NO: 13987 - DNA, 17 bp, Artificial Sequence
  Oligonucleotide probe
  misc_binding (1)..(17): Hybridization probe for the specific detection of mutant HIV-1 at codon 89 of the protease gene.
  modified_base (3)..(3): base is a locked nucleic acid
grmgraaytgttgacyc

SEQ ID NO: 13988 - DNA, 17 bp, Artificial Sequence
  Oligonucleotide probe
  misc_binding (1)..(17): Hybridization probe for the specific detection of mutant HIV-1 at codon 89 of the protease gene.
  modified_base (17)..(17): base is a locked nucleic acid
grmgraaytgttgacyc

SEQ ID NO: 13989 - DNA, 17 bp, Artificial Sequence
  Oligonucleotide probe
  misc_binding (1)..(17): Hybridization probe for the specific detection of mutant HIV-1 at codon 89 of the protease gene.
  modified_base (13)..(13): base is a locked nucleic acid
grmgraaytgttgacyc

SEQ ID NO: 13990 - DNA, 17 bp, Artificial Sequence
  Oligonucleotide probe
  misc_binding (1)..(17): Hybridization probe for the specific detection of mutant HIV-1 at codon 89 of the protease gene.
  modified_base (12)..(12): base is a locked nucleic acid
grmgraaytgttgacyc

SEQ ID NO: 13991 - DNA, 17 bp, Artificial Sequence
  Oligonucleotide probe
  misc_binding (1)..(17): Hybridization probe for the specific detection of mutant HIV-1 at codon 89 of the protease gene.
  modified_base (14)..(14): base is a locked nucleic acid
grmgraaytgttgacyc

SEQ ID NO: 13992 - DNA, 17 bp, Artificial Sequence
  Oligonucleotide probe
  misc_binding (1)..(17): Hybridization probe for the specific detection of mutant HIV-1 at codon 89 of the protease gene.
  modified_base (2)..(2): base is a locked nucleic acid
  modified_base (8)..(8): base is a locked nucleic acid
  modified_base (9)..(9): base is a locked nucleic acid
grmgraaytgttgacyc

SEQ ID NO: 13993 - DNA, 17 bp, Artificial Sequence
  Oligonucleotide probe
  misc_binding (1)..(17): Hybridization probe for the specific detection of mutant HIV-1 at codon 89 of the protease gene.
  modified_base (3)..(3): base is a locked nucleic acid
  modified_base (8)..(8): base is a locked nucleic acid
  modified_base (9)..(9): base is a locked nucleic acid
grmgraaytgttgacyc

SEQ ID NO: 13994 - DNA, 17 bp, Artificial Sequence
  Oligonucleotide probe
  misc_binding (1)..(17): Hybridization probe for the specific detection of mutant HIV-1 at codon 89 of the protease gene.
  modified_base (7)..(7): base is a locked nucleic acid
  modified_base (8)..(8): base is a locked nucleic acid
  modified_base (9)..(9): base is a locked nucleic acid
grmgraaytgttgacyc

SEQ ID NO: 13995 - DNA, 17 bp, Artificial Sequence
  Oligonucleotide probe
  misc_binding (1)..(17): Hybridization probe for the specific detection of mutant HIV-1 at codon 89 of the protease gene.
  modified_base (5)..(5): base is a locked nucleic acid
  modified_base (8)..(8): base is a locked nucleic acid
  modified_base (9)..(9): base is a locked nucleic acid
grmgraaytgttgacyc

SEQ ID NO: 13996 - DNA, 17 bp, Artificial Sequence
  Oligonucleotide probe
  misc_binding (1)..(17): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (14)..(14): base is a locked nucleic acid
grmgraaytgttgacyc

SEQ ID NO: 13997 - DNA, 17 bp, Artificial Sequence
  Oligonucleotide probe
  misc_binding (1)..(17): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (10)..(10): base is a locked nucleic acid
grmgraaytgttgacyc

SEQ ID NO: 13998 - DNA, 17 bp, Artificial Sequence
  Oligonucleotide probe
  misc_binding (1)..(17): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (13)..(13): base is a locked nucleic acid
grmgraaytgttgacyc

SEQ ID NO: 13999 - DNA, 17 bp, Artificial Sequence
  Oligonucleotide probe
  misc_binding (1)..(17): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (17)..(17): base is a locked nucleic acid
grmgraaytgttgacyc

SEQ ID NO: 14000 - DNA, 15 bp, Artificial Sequence
  Oligonucleotide probe
  misc_binding (1)..(15): Hybridization probe for the specific detection of mutant HIV-1 at codon 89 of the protease gene.
  modified_base (8)..(8): base is a locked nucleic acid
  modified_base (9)..(9): base is a locked nucleic acid
grmgraaytgttgac

SEQ ID NO: 14001 - DNA, 15 bp, Artificial Sequence
  Oligonucleotide probe
  misc_binding (1)..(15): Hybridization probe for the specific detection of mutant HIV-1 at codon 89 of the protease gene.
  modified_base (1)..(1): base is a locked nucleic acid
grmgraaytgttgac

SEQ ID NO: 14002 - DNA, 15 bp, Artificial Sequence
  Oligonucleotide probe
  misc_binding (1)..(15): Hybridization probe for the specific detection of mutant HIV-1 at codon 89 of the protease gene.
  modified_base (2)..(2): base is a locked nucleic acid
grmgraaytgttgac

SEQ ID NO: 14003 - DNA, 15 bp, Artificial Sequence
  Oligonucleotide probe
  misc_binding (1)..(15): Hybridization probe for the specific detection of mutant HIV-1 at codon 89 of the protease gene.
  modified_base (8)..(8): base is a locked nucleic acid
grmgraaytgttgac

SEQ ID NO: 14004 - DNA, 15 bp, Artificial Sequence
  Oligonucleotide probe
  misc_binding (1)..(15): Hybridization probe for the specific detection of mutant HIV-1 at codon 89 of the protease gene.
  modified_base (3)..(3): base is a locked nucleic acid
grmgraaytgttgac

SEQ ID NO: 14005 - DNA, 16 bp, Artificial Sequence
  Oligonucleotide probe
  misc_binding (1)..(16): Hybridization probe for the specific detection of mutant HIV-1 at codon 89 of the protease gene.
grmgraaytgttgacy

SEQ ID NO: 14006 - DNA, 15 bp, Artificial Sequence
  Oligonucleotide probe
  misc_binding (1)..(15): Hybridization probe for the specific detection of mutant HIV-1 at codon 89 of the protease gene.
  modified_base (13)..(13): base is a locked nucleic acid
grmgraaytgttgac

SEQ ID NO: 14007 - DNA, 15 bp, Artificial Sequence
  Oligonucleotide probe
  misc_binding (1)..(15): Hybridization probe for the specific detection of mutant HIV-1 at codon 89 of the protease gene.
  modified_base (12)..(12): base is a locked nucleic acid
grmgraaytgttgac

SEQ ID NO: 14008 - DNA, 15 bp, Artificial Sequence
  Oligonucleotide probe
  misc_binding (1)..(15): Hybridization probe for the specific detection of mutant HIV-1 at codon 89 of the protease gene.
  modified_base (14)..(14): base is a locked nucleic acid
grmgraaytgttgac

SEQ ID NO: 14009 - DNA, 15 bp, Artificial Sequence
  Oligonucleotide probe
  misc_binding (1)..(15): Hybridization probe for the specific detection of mutant HIV-1 at codon 89 of the protease gene.
  modified_base (2)..(2): base is a locked nucleic acid
  modified_base (8)..(8): base is a locked nucleic acid
  modified_base (9)..(9): base is a locked nucleic acid
grmgraaytgttgac

SEQ ID NO: 14010 - DNA, 15 bp, Artificial Sequence
  Oligonucleotide probe
  misc_binding (1)..(15): Hybridization probe for the specific detection of mutant HIV-1 at codon 89 of the protease gene.
  modified_base (3)..(3): base is a locked nucleic acid
  modified_base (8)..(8): base is a locked nucleic acid
  modified_base (9)..(9): base is a locked nucleic acid
grmgraaytgttgac

SEQ ID NO: 14011 - DNA, 15 bp, Artificial Sequence
  Oligonucleotide probe
  misc_binding (1)..(15): Hybridization probe for the specific detection of mutant HIV-1 at codon 89 of the protease gene.
  modified_base (7)..(7): base is a locked nucleic acid
  modified_base (8)..(8): base is a locked nucleic acid
  modified_base (9)..(9): base is a locked nucleic acid
grmgraaytgttgac

SEQ ID NO: 14012 - DNA, 15 bp, Artificial Sequence
  Oligonucleotide probe
  misc_binding (1)..(15): Hybridization probe for the specific detection of mutant HIV-1 at codon 89 of the protease gene.
  modified_base (5)..(5): base is a locked nucleic acid
  modified_base (8)..(8): base is a locked nucleic acid
  modified_base (9)..(9): base is a locked nucleic acid
grmgraaytgttgac

SEQ ID NO: 14013 - DNA, 15 bp, Artificial Sequence
  Oligonucleotide probe
  misc_binding (1)..(15): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (14)..(14): base is a locked nucleic acid
grmgraaytgttgac

SEQ ID NO: 14014 - DNA, 15 bp, Artificial Sequence
  Oligonucleotide probe
  misc_binding (1)..(15): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (10)..(10): base is a locked nucleic acid
grmgraaytgttgac

SEQ ID NO: 14015 - DNA, 15 bp, Artificial Sequence
  Oligonucleotide probe
  misc_binding (1)..(15): Hybridization probe for the specific detection of mutant HIV-1 at codon 89 of the protease gene.
  modified_base (8)..(8): base is a locked nucleic acid
  modified_base (9)..(9): base is a locked nucleic acid
  modified_base (13)..(13): base is a locked nucleic acid
grmgraaytgttgac

SEQ ID NO: 14016 - DNA, 16 bp, Artificial Sequence
  Oligonucleotide probe
  misc_binding (1)..(16): Hybridization probe for the specific detection of mutant HIV-1 at codon 89 of the protease gene.
  modified_base (8)..(8): base is a locked nucleic acid
  modified_base (9)..(9): base is a locked nucleic acid
grmgraaytgttgacy

SEQ ID NO: 14017 - DNA, 15 bp, Artificial Sequence
  Oligonucleotide probe
  misc_binding (1)..(15): Hybridization probe for the specific detection of mutant HIV-1 at codon 89 of the protease gene.
aagaaatgtrttgac

SEQ ID NO: 14018 - DNA, 19 bp, Artificial Sequence
  Oligonucleotide probe
  misc_binding (1)..(19): Hybridization probe for the specific detection of mutant HIV-1 at codon 89 of the protease gene.
ggrmgraaytgttgacyca

SEQ ID NO: 14019 - DNA, 18 bp, Artificial Sequence
  Oligonucleotide probe
  misc_binding (1)..(18): Hybridization probe for the specific detection of mutant HIV-1 at codon 89 of the protease gene.
ggrmgraaytgttgacyc

SEQ ID NO: 14020 - DNA, 17 bp, Artificial Sequence
  Oligonucleotide probe
  misc_binding (1)..(17): Hybridization probe for the specific detection of mutant HIV-1 at codon 89 of the protease gene.
grmgraaytgttgacyc

SEQ ID NO: 14021 - DNA, 15 bp, Artificial Sequence
  Oligonucleotide probe
  misc_binding (1)..(15): Hybridization probe for the specific detection of mutant HIV-1 at codon 89 of the protease gene.
grmgraaytgttgac

SEQ ID NO: 14022 - DNA, 19 bp, Artificial Sequence
  Oligonucleotide probe
  misc_binding (1)..(19): Hybridization probe for the specific detection of mutant HIV-1 at codon 90 of the protease gene.
  modified_base (9)..(9): base is a locked nucleic acid
  modified_base (10)..(10): base is a locked nucleic acid
mgraayhtgtgacycarmt

SEQ ID NO: 14023 - DNA, 19 bp, Artificial Sequence
  Oligonucleotide probe
  misc_binding (1)..(19): Hybridization probe for the specific detection of mutant HIV-1 at codon 90 of the protease gene.
  modified_base (6)..(6): base is a locked nucleic acid
mgraayhtgtgacycarmt

SEQ ID NO: 14024 - DNA, 19 bp, Artificial Sequence
  Oligonucleotide probe
  misc_binding (1)..(19): Hybridization probe for the specific detection of mutant HIV-1 at codon 90 of the protease gene.
  modified_base (8)..(8): base is a locked nucleic acid
mgraayhtgtgacycarmt

SEQ ID NO: 14025 - DNA, 19 bp, Artificial Sequence
  Oligonucleotide probe
  misc_binding (1)..(19): Hybridization probe for the specific detection of mutant HIV-1 at codon 90 of the protease gene.
  modified_base (5)..(5): base is a locked nucleic acid
mgraayhtgtgacycarmt

SEQ ID NO: 14026 - DNA, 19 bp, Artificial Sequence
  Oligonucleotide probe
  misc_binding (1)..(19): Hybridization probe for the specific detection of mutant HIV-1 at codon 90 of the protease gene.
  modified_base (4)..(4): base is a locked nucleic acid
mgraayhtgtgacycarmt

SEQ ID NO: 14027 - DNA, 19 bp, Artificial Sequence
  Oligonucleotide probe
  misc_binding (1)..(19): Hybridization probe for the specific detection of mutant HIV-1 at codon 90 of the protease gene.
  modified_base (16)..(16): base is a locked nucleic acid
mgraayhtgtgacycarmt

SEQ ID NO: 14028 - DNA, 19 bp, Artificial Sequence
  Oligonucleotide probe
  misc_binding (1)..(19): Hybridization probe for the specific detection of mutant HIV-1 at codon 90 of the protease gene.
  modified_base (10)..(10): base is a locked nucleic acid
mgraayhtgtgacycarmt

SEQ ID NO: 14029 - DNA, 19 bp, Artificial Sequence
  Oligonucleotide probe
  misc_binding (1)..(19): Hybridization probe for the specific detection of mutant HIV-1 at codon 90 of the protease gene.
  modified_base (15)..(15): base is a locked nucleic acid
mgraayhtgtgacycarmt

SEQ ID NO: 14030 - DNA, 19 bp, Artificial Sequence
  Oligonucleotide probe
  misc_binding (1)..(19): Hybridization probe for the specific detection of mutant HIV-1 at codon 90 of the protease gene.
  modified_base (14)..(14): base is a locked nucleic acid
mgraayhtgtgacycarmt

SEQ ID NO: 14031 - DNA, 19 bp, Artificial Sequence
  Oligonucleotide probe
  misc_binding (1)..(19): Hybridization probe for the specific detection of mutant HIV-1 at codon 90 of the protease gene.
  modified_base (5)..(5): base is a locked nucleic acid
  modified_base (9)..(9): base is a locked nucleic acid
  modified_base (10)..(10): base is a locked nucleic acid
mgraayhtgtgacycarmt

SEQ ID NO: 14032 - DNA, 19 bp, Artificial Sequence
  Oligonucleotide probe
  misc_binding (1)..(19): Hybridization probe for the specific detection of mutant HIV-1 at codon 90 of the protease gene.
  modified_base (2)..(2): base is a locked nucleic acid
  modified_base (9)..(9): base is a locked nucleic acid
  modified_base (10)..(10): base is a locked nucleic acid
mgraayhtgtgacycarmt

SEQ ID NO: 14033 - DNA, 19 bp, Artificial Sequence
  Oligonucleotide probe
  misc_binding (1)..(19): Hybridization probe for the specific detection of mutant HIV-1 at codon 90 of the protease gene.
  modified_base (3)..(3): base is a locked nucleic acid
  modified_base (9)..(9): base is a locked nucleic acid
  modified_base (10)..(10): base is a locked nucleic acid
mgraayhtgtgacycarmt

SEQ ID NO: 14034 - DNA, 19 bp, Artificial Sequence
  Oligonucleotide probe
  misc_binding (1)..(19): Hybridization probe for the specific detection of mutant HIV-1 at codon 90 of the protease gene.
  modified_base (6)..(6): base is a locked nucleic acid
  modified_base (9)..(9): base is a locked nucleic acid
  modified_base (10)..(10): base is a locked nucleic acid
mgraayhtgtgacycarmt

SEQ ID NO: 14035 - DNA, 19 bp, Artificial Sequence
  Oligonucleotide probe
  misc_binding (1)..(19): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (17)..(17): base is a locked nucleic acid
mgraayhtgtgacycarmt

SEQ ID NO: 14036 - DNA, 19 bp, Artificial Sequence
  Oligonucleotide probe
  misc_binding (1)..(19): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (11)..(11): base is a locked nucleic acid
mgraayhtgtgacycarmt

SEQ ID NO: 14037 - DNA, 19 bp, Artificial Sequence
  Oligonucleotide probe
  misc_binding (1)..(19): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (14)..(14): base is a locked nucleic acid
mgraayhtgtgacycarmt

SEQ ID NO: 14038 - DNA, 19 bp, Artificial Sequence
  Oligonucleotide probe
  misc_binding (1)..(19): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (16)..(16): base is a locked nucleic acid
mgraayhtgtgacycarmt

SEQ ID NO: 14039 - DNA, 18 bp, Artificial Sequence
  Oligonucleotide probe
  misc_binding (1)..(18): Hybridization probe for the specific detection of mutant HIV-1 at codon 90 of the protease gene.
  modified_base (9)..(9): base is a locked nucleic acid
  modified_base (10)..(10): base is a locked nucleic acid
mgraayhtgtgacycarm

SEQ ID NO: 14040 - DNA, 18 bp, Artificial Sequence
  Oligonucleotide probe
  misc_binding (1)..(18): Hybridization probe for the specific detection of mutant HIV-1 at codon 90 of the protease gene.
  modified_base (6)..(6): base is a locked nucleic acid
mgraayhtgtgacycarm

SEQ ID NO: 14041 - DNA, 18 bp, Artificial Sequence
  Oligonucleotide probe
  misc_binding (1)..(18): Hybridization probe for the specific detection of mutant HIV-1 at codon 90 of the protease gene.
  modified_base (8)..(8): base is a locked nucleic acid
mgraayhtgtgacycarm

SEQ ID NO: 14042 - DNA, 18 bp, Artificial Sequence
  Oligonucleotide probe
  misc_binding (1)..(18): Hybridization probe for the specific detection of mutant HIV-1 at codon 90 of the protease gene.
  modified_base (5)..(5): base is a locked nucleic acid
mgraayhtgtgacycarm

SEQ ID NO: 14043 - DNA, 18 bp, Artificial Sequence
  Oligonucleotide probe
  misc_binding (1)..(18): Hybridization probe for the specific detection of mutant HIV-1 at codon 90 of the protease gene.
  modified_base (4)..(4): base is a locked nucleic acid
mgraayhtgtgacycarm

SEQ ID NO: 14044 - DNA, 18 bp, Artificial Sequence
  Oligonucleotide probe
  misc_binding (1)..(18): Hybridization probe for the specific detection of mutant HIV-1 at codon 90 of the protease gene.
  modified_base (16)..(16): base is a locked nucleic acid
mgraayhtgtgacycarm

SEQ ID NO: 14045 - DNA, 18 bp, Artificial Sequence
  Oligonucleotide probe
  misc_binding (1)..(18): Hybridization probe for the specific detection of mutant HIV-1 at codon 90 of the protease gene.
  modified_base (10)..(10): base is a locked nucleic acid
mgraayhtgtgacycarm

SEQ ID NO: 14046 - DNA, 18 bp, Artificial Sequence
  Oligonucleotide probe
  misc_binding (1)..(18): Hybridization probe for the specific detection of mutant HIV-1 at codon 90 of the protease gene.
  modified_base (15)..(15): base is a locked nucleic acid
mgraayhtgtgacycarm

SEQ ID NO: 14047 - DNA, 18 bp, Artificial Sequence
  Oligonucleotide probe
  misc_binding (1)..(18): Hybridization probe for the specific detection of mutant HIV-1 at codon 90 of the protease gene.
  modified_base (14)..(14): base is a locked nucleic acid
mgraayhtgtgacycarm

SEQ ID NO: 14048 - DNA, 18 bp, Artificial Sequence
  Oligonucleotide probe
  misc_binding (1)..(18): Hybridization probe for the specific detection of mutant HIV-1 at codon 90 of the protease gene.
  modified_base (5)..(5): base is a locked nucleic acid
  modified_base (9)..(9): base is a locked nucleic acid
  modified_base (10)..(10): base is a locked nucleic acid
mgraayhtgtgacycarm

SEQ ID NO: 14049 - DNA, 18 bp, Artificial Sequence
  Oligonucleotide probe
  misc_binding (1)..(18): Hybridization probe for the specific detection of mutant HIV-1 at codon 90 of the protease gene.
  modified_base (2)..(2): base is a locked nucleic acid
  modified_base (9)..(9): base is a locked nucleic acid
  modified_base (10)..(10): base is a locked nucleic acid
mgraayhtgtgacycarm

SEQ ID NO: 14050 - DNA, 18 bp, Artificial Sequence
  Oligonucleotide probe
  misc_binding (1)..(18): Hybridization probe for the specific detection of mutant HIV-1 at codon 90 of the protease gene.
  modified_base (3)..(3): base is a locked nucleic acid
  modified_base (9)..(9): base is a locked nucleic acid
  modified_base (10)..(10): base is a locked nucleic acid
mgraayhtgtgacycarm

SEQ ID NO: 14051 - DNA, 18 bp, Artificial Sequence
  Oligonucleotide probe
  misc_binding (1)..(18): Hybridization probe for the specific detection of mutant HIV-1 at codon 90 of the protease gene.
  modified_base (6)..(6): base is a locked nucleic acid
  modified_base (9)..(9): base is a locked nucleic acid
  modified_base (10)..(10): base is a locked nucleic acid
mgraayhtgtgacycarm

SEQ ID NO: 14052 - DNA, 18 bp, Artificial Sequence
  Oligonucleotide probe
  misc_binding (1)..(18): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (17)..(17): base is a locked nucleic acid
mgraayhtgtgacycarm

SEQ ID NO: 14053 - DNA, 18 bp, Artificial Sequence
  Oligonucleotide probe
  misc_binding (1)..(18): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (11)..(11): base is a locked nucleic acid
mgraayhtgtgacycarm

SEQ ID NO: 14054 - DNA, 18 bp, Artificial Sequence
  Oligonucleotide probe
  misc_binding (1)..(18): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (14)..(14): base is a locked nucleic acid
mgraayhtgtgacycarm

SEQ ID NO: 14055 - DNA, 18 bp, Artificial Sequence
  Oligonucleotide probe
  misc_binding (1)..(18): Hybridization probe for the specific detection of mutant HIV-1 at codon 90 of the protease gene.
  modified_base (9)..(9): base is a locked nucleic acid
  modified_base (10)..(10): base is a locked nucleic acid
  modified_base (16)..(16): base is a locked nucleic acid
mgraayhtgtgacycarm

SEQ ID NO: 14056 - DNA, 17 bp, Artificial Sequence
  Oligonucleotide probe
  misc_binding (1)..(17): Hybridization probe for the specific detection of mutant HIV-1 at codon 90 of the protease gene.
  modified_base (8)..(8): base is a locked nucleic acid
  modified_base (9)..(9): base is a locked nucleic acid
graayhtgtgacycarm

SEQ ID NO: 14057 - DNA, 17 bp, Artificial Sequence
  Oligonucleotide probe
  misc_binding (1)..(17): Hybridization probe for the specific detection of mutant HIV-1 at codon 90 of the protease gene.
  modified_base (5)..(5): base is a locked nucleic acid
graayhtgtgacycarm

SEQ ID NO: 14058 - DNA, 17 bp, Artificial Sequence
  Oligonucleotide probe
  misc_binding (1)..(17): Hybridization probe for the specific detection of mutant HIV-1 at codon 90 of the protease gene.
  modified_base (7)..(7): base is a locked nucleic acid
graayhtgtgacycarm

SEQ ID NO: 14059 - DNA, 17 bp, Artificial Sequence
  Oligonucleotide probe
  misc_binding (1)..(17): Hybridization probe for the specific detection of mutant HIV-1 at codon 90 of the protease gene.
  modified_base (4)..(4): base is a locked nucleic acid
graayhtgtgacycarm

SEQ ID NO: 14060 - DNA, 17 bp, Artificial Sequence
  Oligonucleotide probe
  misc_binding (1)..(17): Hybridization probe for the specific detection of mutant HIV-1 at codon 90 of the protease gene.
  modified_base (3)..(3): base is a locked nucleic acid
graayhtgtgacycarm

SEQ ID NO: 14061 - DNA, 17 bp, Artificial Sequence
  Oligonucleotide probe
  misc_binding (1)..(17): Hybridization probe for the specific detection of mutant HIV-1 at codon 90 of the protease gene.
  modified_base (15)..(15): base is a locked nucleic acid
graayhtgtgacycarm

SEQ ID NO: 14062 - DNA, 17 bp, Artificial Sequence
  Oligonucleotide probe
  misc_binding (1)..(17): Hybridization probe for the specific detection of mutant HIV-1 at codon 90 of the protease gene.
  modified_base (9)..(9): base is a locked nucleic acid
graayhtgtgacycarm

SEQ ID NO: 14063 - DNA, 17 bp, Artificial Sequence
  Oligonucleotide probe
  misc_binding (1)..(17): Hybridization probe for the specific detection of mutant HIV-1 at codon 90 of the protease gene.
  modified_base (14)..(14): base is a locked nucleic acid
graayhtgtgacycarm

SEQ ID NO: 14064 - DNA, 17 bp, Artificial Sequence
  Oligonucleotide probe
  misc_binding (1)..(17): Hybridization probe for the specific detection of mutant HIV-1 at codon 90 of the protease gene.
  modified_base (13)..(13): base is a locked nucleic acid
graayhtgtgacycarm

SEQ ID NO: 14065 - DNA, 17 bp, Artificial Sequence
  Oligonucleotide probe
  misc_binding (1)..(17): Hybridization probe for the specific detection of mutant HIV-1 at codon 90 of the protease gene.
  modified_base (4)..(4): base is a locked nucleic acid
  modified_base (8)..(8): base is a locked nucleic acid
  modified_base (9)..(9): base is a locked nucleic acid
graayhtgtgacycarm

SEQ ID NO: 14066 - DNA, 17 bp, Artificial Sequence
  Oligonucleotide probe
  misc_binding (1)..(17): Hybridization probe for the specific detection of mutant HIV-1 at codon 90 of the protease gene.
  modified_base (1)..(1): base is a locked nucleic acid
  modified_base (8)..(8): base is a locked nucleic acid
  modified_base (9)..(9): base is a locked nucleic acid
graayhtgtgacycarm

SEQ ID NO: 14067 - DNA, 17 bp, Artificial Sequence
  Oligonucleotide probe
  misc_binding (1)..(17): Hybridization probe for the specific detection of mutant HIV-1 at codon 90 of the protease gene.
  modified_base (2)..(2): base is a locked nucleic acid
  modified_base (8)..(8): base is a locked nucleic acid
  modified_base (9)..(9): base is a locked nucleic acid
graayhtgtgacycarm

SEQ ID NO: 14068 - DNA, 17 bp, Artificial Sequence
  Oligonucleotide probe
  misc_binding (1)..(17): Hybridization probe for the specific detection of mutant HIV-1 at codon 90 of the protease gene.
  modified_base (5)..(5): base is a locked nucleic acid
  modified_base (8)..(8): base is a locked nucleic acid
  modified_base (9)..(9): base is a locked nucleic acid
graayhtgtgacycarm

SEQ ID NO: 14069 - DNA, 17 bp, Artificial Sequence
  Oligonucleotide probe
  misc_binding (1)..(17): Hybridization probe for the specific detection of mutant HIV-1 at codon 90 of the protease gene.
  modified_base (8)..(8): base is a locked nucleic acid
  modified_base (9)..(9): base is a locked nucleic acid
  modified_base (16)..(16): base is a locked nucleic acid
graayhtgtgacycarm

SEQ ID NO: 14070 - DNA, 17 bp, Artificial Sequence
  Oligonucleotide probe
  misc_binding (1)..(17): Hybridization probe for the specific detection of mutant HIV-1 at codon 90 of the protease gene.
  modified_base (8)..(8): base is a locked nucleic acid
  modified_base (9)..(9): base is a locked nucleic acid
  modified_base (10)..(10): base is a locked nucleic acid
graayhtgtgacycarm

SEQ ID NO: 14071 - DNA, 17 bp, Artificial Sequence
  Oligonucleotide probe
  misc_binding (1)..(17): Hybridization probe for the specific detection of mutant HIV-1 at codon 90 of the protease gene.
  modified_base (8)..(8): base is a locked nucleic acid
  modified_base (9)..(9): base is a locked nucleic acid
  modified_base (13)..(13): base is a locked nucleic acid
graayhtgtgacycarm

SEQ ID NO: 14072 - DNA, 17 bp, Artificial Sequence
  Oligonucleotide probe
  misc_binding (1)..(17): Hybridization probe for the specific detection of mutant HIV-1 at codon 90 of the protease gene.
  modified_base (8)..(8): base is a locked nucleic acid
  modified_base (9)..(9): base is a locked nucleic acid
  modified_base (15)..(15): base is a locked nucleic acid
graayhtgtgacycarm

SEQ ID NO: 14073 - DNA, 15 bp, Artificial Sequence
  Oligonucleotide probe
  misc_binding (1)..(15): Hybridization probe for the specific detection of mutant HIV-1 at codon 90 of the protease gene.
  modified_base (8)..(8): base is a locked nucleic acid
  modified_base (9)..(9): base is a locked nucleic acid
graayhtgtgacyca

SEQ ID NO: 14074 - DNA, 15 bp, Artificial Sequence
  Oligonucleotide probe
  misc_binding (1)..(15): Hybridization probe for the specific detection of mutant HIV-1 at codon 90 of the protease gene.
  modified_base (5)..(5): base is a locked nucleic acid
graayhtgtgacyca

SEQ ID NO: 14075 - DNA, 15 bp, Artificial Sequence
  Oligonucleotide probe
  misc_binding (1)..(15): Hybridization probe for the specific detection of mutant HIV-1 at codon 90 of the protease gene.
  modified_base (7)..(7): base is a locked nucleic acid
graayhtgtgacyca

SEQ ID NO: 14076 - DNA, 15 bp, Artificial Sequence
  Oligonucleotide probe
  misc_binding (1)..(15): Hybridization probe for the specific detection of mutant HIV-1 at codon 90 of the protease gene.
  modified_base (4)..(4): base is a locked nucleic acid
graayhtgtgacyca

SEQ ID NO: 14077 - DNA, 15 bp, Artificial Sequence
  Oligonucleotide probe
  misc_binding (1)..(15): Hybridization probe for the specific detection of mutant HIV-1 at codon 90 of the protease gene.
  modified_base (3)..(3): base is a locked nucleic acid
graayhtgtgacyca

SEQ ID NO: 14078 - DNA, 15 bp, Artificial Sequence
  Oligonucleotide probe
  misc_binding (1)..(15): Hybridization probe for the specific detection of mutant HIV-1 at codon 90 of the protease gene.
  modified_base (15)..(15): base is a locked nucleic acid
graayhtgtgacyca

SEQ ID NO: 14079 - DNA, 15 bp, Artificial Sequence
  Oligonucleotide probe
  misc_binding (1)..(15): Hybridization probe for the specific detection of mutant HIV-1 at codon 90 of the protease gene.
  modified_base (9)..(9): base is a locked nucleic acid
graayhtgtgacyca

SEQ ID NO: 14080 - DNA, 15 bp, Artificial Sequence
  Oligonucleotide probe
  misc_binding (1)..(15): Hybridization probe for the specific detection of mutant HIV-1 at codon 90 of the protease gene.
  modified_base (14)..(14): base is a locked nucleic acid
graayhtgtgacyca

SEQ ID NO: 14081 - DNA, 15 bp, Artificial Sequence
  Oligonucleotide probe
  misc_binding (1)..(15): Hybridization probe for the specific detection of mutant HIV-1 at codon 90 of the protease gene.
  modified_base (13)..(13): base is a locked nucleic acid
graayhtgtgacyca

SEQ ID NO: 14082 - DNA, 15 bp, Artificial Sequence
  Oligonucleotide probe
  misc_binding (1)..(15): Hybridization probe for the specific detection of mutant HIV-1 at codon 90 of the protease gene.
  modified_base (4)..(4): base is a locked nucleic acid
  modified_base (8)..(8): base is a locked nucleic acid
  modified_base (9)..(9): base is a locked nucleic acid
graayhtgtgacyca

SEQ ID NO: 14083 - DNA, 15 bp, Artificial Sequence
  Oligonucleotide probe
  misc_binding (1)..(15): Hybridization probe for the specific detection of mutant HIV-1 at codon 90 of the protease gene.
  modified_base (1)..(1): base is a locked nucleic acid
  modified_base (8)..(8): base is a locked nucleic acid
  modified_base (9)..(9): base is a locked nucleic acid
graayhtgtgacyca

SEQ ID NO: 14084 - DNA, 15 bp, Artificial Sequence
  Oligonucleotide probe
  misc_binding (1)..(15): Hybridization probe for the specific detection of mutant HIV-1 at codon 90 of the protease gene.
  modified_base (2)..(2): base is a locked nucleic acid
  modified_base (8)..(8): base is a locked nucleic acid
  modified_base (9)..(9): base is a locked nucleic acid
graayhtgtgacyca

SEQ ID NO: 14085 - DNA, 15 bp, Artificial Sequence
  Oligonucleotide probe
  misc_binding (1)..(15): Hybridization probe for the specific detection of mutant HIV-1 at codon 90 of the protease gene.
  modified_base (5)..(5): base is a locked nucleic acid
  modified_base (8)..(8): base is a locked nucleic acid
  modified_base (9)..(9): base is a locked nucleic acid
graayhtgtgacyca

SEQ ID NO: 14086 - DNA, 15 bp, Artificial Sequence
  Oligonucleotide probe
  misc_binding (1)..(15): Hybridization probe for the specific detection of mutant HIV-1 at codon 90 of the protease gene.
  modified_base (8)..(8): base is a locked nucleic acid
  modified_base (9)..(9): base is a locked nucleic acid
graayhtgtgacyca

SEQ ID NO: 14087 - DNA, 15 bp, Artificial Sequence
  Oligonucleotide probe
  misc_binding (1)..(15): Hybridization probe for the specific detection of mutant HIV-1 at codon 90 of the protease gene.
  modified_base (8)..(8): base is a locked nucleic acid
  modified_base (9)..(9): base is a locked nucleic acid
  modified_base (10)..(10): base is a locked nucleic acid
graayhtgtgacyca

SEQ ID NO: 14088 - DNA, 15 bp, Artificial Sequence
  Oligonucleotide probe
  misc_binding (1)..(15): Hybridization probe for the specific detection of mutant HIV-1 at codon 90 of the protease gene.
  modified_base (8)..(8): base is a locked nucleic acid
  modified_base (9)..(9): base is a locked nucleic acid
  modified_base (13)..(13): base is a locked nucleic acid
graayhtgtgacyca

SEQ ID NO: 14089 - DNA, 15 bp, Artificial Sequence
  Oligonucleotide probe
  misc_binding (1)..(15): Hybridization probe for the specific detection of mutant HIV-1 at codon 90 of the protease gene.
  modified_base (8)..(8): base is a locked nucleic acid
  modified_base (9)..(9): base is a locked nucleic acid
  modified_base (15)..(15): base is a locked nucleic acid
graayhtgtgacyca

SEQ ID NO: 14090 - DNA, 15 bp, Artificial Sequence
  Oligonucleotide probe
  misc_binding (1)..(15): Hybridization probe for the specific detection of mutant HIV-1 at codon 90 of the protease gene.
aaatctgatgactca

SEQ ID NO: 14091 - DNA, 19 bp, Artificial Sequence
  Oligonucleotide probe
  misc_binding (1)..(19): Hybridization probe for the specific detection of mutant HIV-1 at codon 90 of the protease gene.
mgraayhtgtgacycarmt

SEQ ID NO: 14092 - DNA, 18 bp, Artificial Sequence
  Oligonucleotide probe
  misc_binding (1)..(18): Hybridization probe for the specific detection of mutant HIV-1 at codon 90 of the protease gene.
mgraayhtgtgacycarm

SEQ ID NO: 14093 - DNA, 17 bp, Artificial Sequence
  Oligonucleotide probe
  misc_binding (1)..(17): Hybridization probe for the specific detection of mutant HIV-1 at codon 90 of the protease gene.
graayhtgtgacycarm

SEQ ID NO: 14094 - DNA, 15 bp, Artificial Sequence
  Oligonucleotide probe
  misc_binding (1)..(15): Hybridization probe for the specific detection of mutant HIV-1 at codon 90 of the protease gene.
graayhtgtgacyca

SEQ ID NO: 14095 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 51 to correspond to the nucleotides in an oligonucleotide probe upstream of the discriminating single nucleotide polymorphism.
atagtrgcywrytgtgayaartgycarbtaaaaggrgaagccatg

SEQ ID NO: 14096 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 51 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
atagtrgcywrytgtgayaartgycarbtaaaaggrgaagccatgn

SEQ ID NO: 14097 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.
acargtrgaytgyagyccaggratatggcarytagaytgy

SEQ ID NO: 14098 - DNA, 40 bp, Artificial Sequence; identical to SEQ ID NO: 14097
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14099 - DNA, 40 bp, Artificial Sequence; identical to SEQ ID NO: 14097
  Pan degenerate oligonucleotide primer
  primer_bind (1)..(40)
  modified_base (2)..(2): base is a locked nucleic acid
  modified_base (3)..(3): base is a locked nucleic acid
  modified_base (9)..(9): base is a locked nucleic acid
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14100 - DNA, 38 bp, Artificial Sequence
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate sense primer that adapts the probe-binding site upstream of codon 66 to correspond to the nucleotides in an oligonucleotide probe upstream of the discriminating single nucleotide polymorphism.
argtrgaytgyagyccaggratatggcarytagaytgy

SEQ ID NO: 14101 - DNA, 38 bp, Artificial Sequence; identical to SEQ ID NO: 14100
  Pan degenerate oligonucleotide primer
  primer_bind (1)..(38)
  modified_base (1)..(1): base is a locked nucleic acid
  modified_base (7)..(7): base is a locked nucleic acid
  modified_base (10)..(10): base is a locked nucleic acid
  misc_feature (32)..(38): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14102 - DNA, 38 bp, Artificial Sequence; identical to SEQ ID NO: 14100
  Pan degenerate oligonucleotide primer
  primer_bind (1)..(38)
  modified_base (1)..(1): base is a locked nucleic acid
  modified_base (4)..(4): base is a locked nucleic acid
  modified_base (10)..(10): base is a locked nucleic acid
  misc_feature (32)..(38): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14103 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 66 to correspond to the nucleotides in an oligonucleotide probe upstream of the discriminating single nucleotide polymorphism.
trgaytgyagyccaggratatggcarytagaytgy

SEQ ID NO: 14104 - DNA, 35 bp, Artificial Sequence; identical to SEQ ID NO: 14103
  Pan degenerate oligonucleotide primer
  primer_bind (1)..(35)
  modified_base (1)..(1): base is a locked nucleic acid
  modified_base (7)..(7): base is a locked nucleic acid
  modified_base (12)..(12): base is a locked nucleic acid
  misc_feature (29)..(35): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14105 - DNA, 35 bp, Artificial Sequence; identical to SEQ ID NO: 14103
  Pan degenerate oligonucleotide primer
  primer_bind (1)..(35)
  modified_base (1)..(1): base is a locked nucleic acid
  modified_base (4)..(4): base is a locked nucleic acid
  modified_base (12)..(12): base is a locked nucleic acid
  misc_feature (29)..(35): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14106 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (9)..(9): base is a locked nucleic acid
  misc_feature (26)..(32): Adaptor region of the pan degenerate sense primer that adapts the probe-binding site upstream of codon 66 to correspond to the nucleotides in an oligonucleotide probe upstream of the discriminating single nucleotide polymorphism.
aytgyagyccaggratatggcarytagaytgy

SEQ ID NO: 14107 - DNA, 32 bp, Artificial Sequence; identical to SEQ ID NO: 14106
  Pan degenerate oligonucleotide primer
  primer_bind (1)..(32)
  modified_base (1)..(1): base is a locked nucleic acid
  modified_base (9)..(9): base is a locked nucleic acid
  modified_base (10)..(10): base is a locked nucleic acid
  misc_feature (26)..(32): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14108 - DNA, 32 bp, Artificial Sequence; identical to SEQ ID NO: 14106
  Pan degenerate oligonucleotide primer
  primer_bind (1)..(32)
  modified_base (1)..(1): base is a locked nucleic acid
  modified_base (4)..(4): base is a locked nucleic acid
  modified_base (10)..(10): base is a locked nucleic acid
  misc_feature (26)..(32): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14109 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate sense primer that adapts the probe-binding site upstream of codon 66 to correspond to the nucleotides in an oligonucleotide probe upstream of the discriminating single nucleotide polymorphism.
gyagyccaggratatggcarytagaytgy

SEQ ID NO: 14110 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (9)..(9): base is a locked nucleic acid
  misc_feature (23)..(29): Adaptor region of the pan degenerate sense primer that adapts the probe-binding site upstream of codon 66 to correspond to the nucleotides in an oligonucleotide probe upstream of the discriminating single nucleotide polymorphism.
gyagyccaggratatggcarytagaytgy

SEQ ID NO: 14111 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (9)..(9): base is a locked nucleic acid
  misc_feature (23)..(29): Adaptor region of the pan degenerate sense primer that adapts the probe-binding site upstream of codon 66 to correspond to the nucleotides in an oligonucleotide probe upstream of the discriminating single nucleotide polymorphism.
gyagyccaggratatggcarytagaytgy

SEQ ID NO: 14112 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgy

SEQ ID NO: 14113 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (10)..(10): base is a locked nucleic acid
  misc_feature (18)..(24): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgy

SEQ ID NO: 14114 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (10)..(10): base is a locked nucleic acid
  misc_feature (18)..(24): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgy

SEQ ID NO: 14115 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.
cargtrgaytgyagyccaggratatggcarytagaytgya

SEQ ID NO: 14116 - DNA, 40 bp, Artificial Sequence; identical to SEQ ID NO: 14115
  Pan degenerate oligonucleotide primer
  primer_bind (1)..(40)
  modified_base (1)..(1): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14117 - DNA, 40 bp, Artificial Sequence; identical to SEQ ID NO: 14115
  Pan degenerate oligonucleotide primer
  primer_bind (1)..(40)
  modified_base (1)..(1): base is a locked nucleic acid
  modified_base (2)..(2): base is a locked nucleic acid
  modified_base (8)..(8): base is a locked nucleic acid
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14118 - DNA, 39 bp, Artificial Sequence
  Pan degenerate oligonucleotide primer
  primer_bind (1)..(39)
  modified_base (1)..(1): base is a locked nucleic acid
  modified_base (4)..(4): base is a locked nucleic acid
  modified_base (7)..(7): base is a locked nucleic acid
  misc_feature (33)..(39): Adaptor region of the pan degenerate sense primer that adapts the probe-binding site upstream of codon 66 to correspond to the nucleotides in an oligonucleotide probe upstream of the discriminating single nucleotide polymorphism.
argtrgaytgyagyccaggratatggcarytagaytgya

SEQ ID NO: 14119 - DNA, 39 bp, Artificial Sequence; identical to SEQ ID NO: 14118
  Pan degenerate oligonucleotide primer
  primer_bind (1)..(39)
  modified_base (1)..(1): base is a locked nucleic acid
  modified_base (7)..(7): base is a locked nucleic acid
  modified_base (10)..(10): base is a locked nucleic acid
  misc_feature (33)..(39): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14120 - DNA, 39 bp, Artificial Sequence; identical to SEQ ID NO: 14118
  Pan degenerate oligonucleotide primer
  primer_bind (1)..(39)
  modified_base (1)..(1): base is a locked nucleic acid
  modified_base (4)..(4): base is a locked nucleic acid
  modified_base (10)..(10): base is a locked nucleic acid
  misc_feature (33)..(39): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14121 - DNA, 36 bp, Artificial Sequence
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate sense primer that adapts the probe-binding site upstream of codon 66 to correspond to the nucleotides in an oligonucleotide probe upstream of the discriminating single nucleotide polymorphism.
trgaytgyagyccaggratatggcarytagaytgya

SEQ ID NO: 14122 - DNA, 36 bp, Artificial Sequence; identical to SEQ ID NO: 14121
  Pan degenerate oligonucleotide primer
  primer_bind (1)..(36)
  modified_base (1)..(1): base is a locked nucleic acid
  modified_base (7)..(7): base is a locked nucleic acid
  modified_base (12)..(12): base is a locked nucleic acid
  misc_feature (30)..(36): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14123 - DNA, 36 bp, Artificial Sequence; identical to SEQ ID NO: 14121
  Pan degenerate oligonucleotide primer
  primer_bind (1)..(36)
  modified_base (1)..(1): base is a locked nucleic acid
  modified_base (4)..(4): base is a locked nucleic acid
  modified_base (12)..(12): base is a locked nucleic acid
  misc_feature (30)..(36): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14124 - DNA, 33 bp, Artificial Sequence
  Pan degenerate oligonucleotide primer
  primer_bind (1)..(33)
  modified_base (1)..(1): base is a locked nucleic acid
  modified_base (4)..(4): base is a locked nucleic acid
  modified_base (9)..(9): base is a locked nucleic acid
  misc_feature (27)..(33): Adaptor region of the pan degenerate sense primer that adapts the probe-binding site upstream of codon 66 to correspond to the nucleotides in an oligonucleotide probe upstream of the discriminating single nucleotide polymorphism.
aytgyagyccaggratatggcarytagaytgya

SEQ ID NO: 14125 - DNA, 33 bp, Artificial Sequence; identical to SEQ ID NO: 14124
  Pan degenerate oligonucleotide primer
  primer_bind (1)..(33)
  modified_base (1)..(1): base is a locked nucleic acid
  modified_base (9)..(9): base is a locked nucleic acid
  modified_base (10)..(10): base is a locked nucleic acid
  misc_feature (27)..(33): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14126 - DNA, 33 bp, Artificial Sequence; identical to SEQ ID NO: 14124
  Pan degenerate oligonucleotide primer
  primer_bind (1)..(33)
  modified_base (1)..(1): base is a locked nucleic acid
  modified_base (4)..(4): base is a locked nucleic acid
  modified_base (10)..(10): base is a locked nucleic acid
  misc_feature (27)..(33): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14127 - DNA, 30 bp, Artificial Sequence
  Pan degenerate oligonucleotide primer
  primer_bind (1)..(30)
  modified_base (1)..(1): base is a locked nucleic acid
  modified_base (6)..(6): base is a locked nucleic acid
  modified_base (7)..(7): base is a locked nucleic acid
  misc_feature (24)..(30): Adaptor region of the pan degenerate sense primer that adapts the probe-binding site upstream of codon 66 to correspond to the nucleotides in an oligonucleotide probe upstream of the discriminating single nucleotide polymorphism.
gyagyccaggratatggcarytagaytgya

SEQ ID NO: 14128 - DNA, 30 bp, Artificial Sequence; identical to SEQ ID NO: 14127
  Pan degenerate oligonucleotide primer
  primer_bind (1)..(30)
  modified_base (1)..(1): base is a locked nucleic acid
  modified_base (7)..(7): base is a locked nucleic acid
  modified_base (9)..(9): base is a locked nucleic acid
  misc_feature (24)..(30): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14129 - DNA, 30 bp, Artificial Sequence; identical to SEQ ID NO: 14127
  Pan degenerate oligonucleotide primer
  primer_bind (1)..(30)
  modified_base (1)..(1): base is a locked nucleic acid
  modified_base (6)..(6): base is a locked nucleic acid
  modified_base (9)..(9): base is a locked nucleic acid
  misc_feature (24)..(30): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14130 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (4)..(4): base is a locked nucleic acid
  misc_feature (19)..(25): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgya

SEQ ID NO: 14131 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (10)..(10): base is a locked nucleic acid
  misc_feature (19)..(25): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgya

SEQ ID NO: 14132 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (10)..(10): base is a locked nucleic acid
  misc_feature (19)..(25): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgya

SEQ ID NO: 14133 - DNA, 40 bp, Artificial Sequence; identical to SEQ ID NO: 14097
  Pan degenerate oligonucleotide primer
  primer_bind (1)..(40)
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14134 - DNA, 38 bp, Artificial Sequence; identical to SEQ ID NO: 14100
  Pan degenerate oligonucleotide primer
  primer_bind (1)..(38)
  misc_feature (32)..(38): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14135 - DNA, 35 bp, Artificial Sequence; identical to SEQ ID NO: 14103
  Pan degenerate oligonucleotide primer
  primer_bind (1)..(35)
  misc_feature (29)..(35): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14136 - DNA, 32 bp, Artificial Sequence; identical to SEQ ID NO: 14106
  Pan degenerate oligonucleotide primer
  primer_bind (1)..(32)
  misc_feature (26)..(32): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14137 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 66 to correspond to the nucleotides in an oligonucleotide probe upstream of the discriminating single nucleotide polymorphism.
gyagyccaggratatggcarytagaytgy

SEQ ID NO: 14138 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgy

SEQ ID NO: 14139 - DNA, 40 bp, Artificial Sequence; identical to SEQ ID NO: 14115
  Pan degenerate oligonucleotide primer
  primer_bind (1)..(40)
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14140 - DNA, 39 bp, Artificial Sequence; identical to SEQ ID NO: 14118
  Pan degenerate oligonucleotide primer
  primer_bind (1)..(39)
  misc_feature (33)..(39): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14141 - DNA, 36 bp, Artificial Sequence; identical to SEQ ID NO: 14121
  Pan degenerate oligonucleotide primer
  primer_bind (1)..(36)
  misc_feature (30)..(36): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14142 - DNA, 33 bp, Artificial Sequence; identical to SEQ ID NO: 14124
  Pan degenerate oligonucleotide primer
  primer_bind (1)..(33)
  misc_feature (27)..(33): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14143 - DNA, 30 bp, Artificial Sequence; identical to SEQ ID NO: 14127
  Pan degenerate oligonucleotide primer
  primer_bind (1)..(30)
  misc_feature (24)..(30): Adaptor region of the pan degenerate sense primer that adapts the probe-binding site upstream of codon 66 to correspond to the nucleotides in an oligonucleotide probe upstream of the discriminating single nucleotide polymorphism.

SEQ ID NO: 14144 - DNA, 25 bp, Artificial Sequence
  Pan degenerate oligonucleotide primer
  primer_bind (1)..(25)
  misc_feature (19)..(25): Adaptor region of the pan degenerate sense primer that adapts the probe-binding site upstream of codon 66 to correspond to the nucleotides in an oligonucleotide probe upstream of the discriminating single nucleotide polymorphism.
ccaggratatggcarytagaytgya

SEQ ID NO: 14145 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 66 to correspond to the nucleotides in an oligonucleotide probe upstream of the discriminating single nucleotide polymorphism.
catggacargtrgaytgyagyccaggratatggcarytagattgt

SEQ ID NO: 14146 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
acargtrgaytgyagyccaggratatggcarytagaytgyn

SEQ ID NO: 14147 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 66 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
argtrgaytgyagyccaggratatggcarytagaytgyn

SEQ ID NO: 14148 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 66 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
trgaytgyagyccaggratatggcarytagaytgyn

SEQ ID NO: 14149 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 66 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
aytgyagyccaggratatggcarytagaytgyn

SEQ ID NO: 14150 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 66 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
gyagyccaggratatggcarytagaytgyn

SEQ ID NO: 14151 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 66 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
ccaggratatggcarytagaytgyn

SEQ ID NO: 14152 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 66 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
cargtrgaytgyagyccaggratatggcarytagaytgyan

SEQ ID NO: 14153 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 66 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
argtrgaytgyagyccaggratatggcarytagaytgyan

SEQ ID NO: 14154 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 66 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
trgaytgyagyccaggratatggcarytagaytgyan

SEQ ID NO: 14155 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 66 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
aytgyagyccaggratatggcarytagaytgyan

SEQ ID NO: 14156 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 66 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
gyagyccaggratatggcarytagaytgyan

SEQ ID NO: 14157 - DNA, 26 bp, Artificial Sequence
  Pan degenerate oligonucleotide primer
  primer_bind (1)..(26)
  misc_feature (19)..(25): Adaptor region of the pan degenerate sense primer that adapts the probe-binding site upstream of codon 66 to correspond to the nucleotides in an oligonucleotide probe upstream of the discriminating single nucleotide polymorphism.
  modified_base (26)..(26): base is a locked nucleic acid
  misc_feature (26)..(26): n is a, c, g, or t
ccaggratatggcarytagaytgyan

SEQ ID NO: 14158 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 66 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
catggacargtrgaytgyagyccaggratatggcarytagattgtn

SEQ ID NO: 14159 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (4)..(4): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.
atggcarytagaytgyacacayytagaaggraaarthaty

SEQ ID NO: 14160 - DNA, 40 bp, Artificial Sequence; identical to SEQ ID NO: 14159
  Pan degenerate oligonucleotide primer
  primer_bind (1)..(40)
  modified_base (2)..(2): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14161 - DNA, 40 bp, Artificial Sequence; identical to SEQ ID NO: 14159
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14162 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (3)..(3): base is a locked nucleic acid
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.
ggcarytagaytgyacacayytagaaggraaarthaty

SEQ ID NO: 14163 - DNA, 38 bp, Artificial Sequence; identical to SEQ ID NO: 14162
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14164 - DNA, 38 bp, Artificial Sequence; identical to SEQ ID NO: 14162
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14165 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (3)..(3): base is a locked nucleic acid
  misc_feature (31)..(37): Adaptor region of the pan degenerate sense primer that adapts the probe-binding site upstream of codon 74 to correspond to the nucleotides in an oligonucleotide probe upstream of the discriminating single nucleotide polymorphism.
gcarytagaytgyacacayytagaaggraaarthaty

SEQ ID NO: 14166 - DNA, 37 bp, Artificial Sequence; identical to SEQ ID NO: 14165
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14167 - DNA, 37 bp, Artificial Sequence; identical to SEQ ID NO: 14165
  Pan degenerate oligonucleotide primer
  primer_bind (1)..(37)
  modified_base (1)..(1): base is a locked nucleic acid
  modified_base (2)..(2): base is a locked nucleic acid
  modified_base (6)..(6): base is a locked nucleic acid
  misc_feature (31)..(37): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14168 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.
carytagaytgyacacayytagaaggraaarthaty

SEQ ID NO: 14169 - DNA, 36 bp, Artificial Sequence; identical to SEQ ID NO: 14168
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14170 - DNA, 36 bp, Artificial Sequence; identical to SEQ ID NO: 14168
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14171 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.
arytagaytgyacacayytagaaggraaarthaty

SEQ ID NO: 14172 - DNA, 35 bp, Artificial Sequence; identical to SEQ ID NO: 14171
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14173 - DNA, 35 bp, Artificial Sequence; identical to SEQ ID NO: 14171
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14174 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.
tagaytgyacacayytagaaggraaarthaty

SEQ ID NO: 14175 - DNA, 32 bp, Artificial Sequence; identical to SEQ ID NO: 14174
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14176 - DNA, 32 bp, Artificial Sequence; identical to SEQ ID NO: 14174
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14177 - DNA, 40 bp, Artificial Sequence; identical to SEQ ID NO: 14159
  Pan degenerate oligonucleotide primer
  primer_bind (1)..(40)
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14178 - DNA, 38 bp, Artificial Sequence; identical to SEQ ID NO: 14162
  Pan degenerate oligonucleotide primer
  primer_bind (1)..(38)
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14179 - DNA, 37 bp, Artificial Sequence; identical to SEQ ID NO: 14165
  Pan degenerate oligonucleotide primer
  primer_bind (1)..(37)
  misc_feature (31)..(37): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14180 - DNA, 36 bp, Artificial Sequence; identical to SEQ ID NO: 14168
  Pan degenerate oligonucleotide primer
  primer_bind (1)..(36)
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14181 - DNA, 35 bp, Artificial Sequence; identical to SEQ ID NO: 14171
  Pan degenerate oligonucleotide primer
  primer_bind (1)..(35)
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14182 - DNA, 32 bp, Artificial Sequence; identical to SEQ ID NO: 14174
  Pan degenerate oligonucleotide primer
  primer_bind (1)..(32)
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 14183 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 74 to correspond to the nucleotides in an oligonucleotide probe upstream of the discriminating single nucleotide polymorphism.
ggratatggcarytagaytgyacacayytagaaggraaaattatc

SEQ ID NO: 14184 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
atggcarytagaytgyacacayytagaaggraaarthatyn

SEQ ID NO: 14185 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
ggcarytagaytgyacacayytagaaggraaarthatyn

SEQ ID NO: 14186 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 74 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
gcarytagaytgyacacayytagaaggraaarthatyn

SEQ ID NO: 14187 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
carytagaytgyacacayytagaaggraaarthatyn

SEQ ID NO: 14188 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 74 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
arytagaytgyacacayytagaaggraaarthatyn

SEQ ID NO: 14189 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
tagaytgyacacayytagaaggraaarthatyn

SEQ ID NO: 14190 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 74 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ggratatggcarytagaytgyacacayytagaaggraaaattatcn

SEQ ID NO: 14191 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.
gtrgcyagtggmtayatrgaagcagargtyatyccagcag

SEQ ID NO: 14192 - DNA, 40 bp, Artificial Sequence; identical to SEQ ID NO: 14191
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14193 - DNA, 40 bp, Artificial Sequence; identical to SEQ ID NO: 14191
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14194 - DNA, 39 bp, Artificial Sequence
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 92 to correspond to the nucleotides in an oligonucleotide probe upstream of the discriminating single nucleotide polymorphism.
trgcyagtggmtayatrgaagcagargtyatyccagcag

SEQ ID NO: 14195 - DNA, 39 bp, Artificial Sequence; identical to SEQ ID NO: 14194
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (33)..(39): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14196 - DNA, 39 bp, Artificial Sequence; identical to SEQ ID NO: 14194
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (33)..(39): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14197 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate sense primer that adapts the probe-binding site upstream of codon 92 to correspond to the nucleotides in an oligonucleotide probe upstream of the discriminating single nucleotide polymorphism.
gcyagtggmtayatrgaagcagargtyatyccagcag

SEQ ID NO: 14198 - DNA, 37 bp, Artificial Sequence; identical to SEQ ID NO: 14197
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14199 - DNA, 37 bp, Artificial Sequence; identical to SEQ ID NO: 14197
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14200 - DNA, 36 bp, Artificial Sequence
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.
cyagtggmtayatrgaagcagargtyatyccagcag

SEQ ID NO: 14201 - DNA, 36 bp, Artificial Sequence; identical to SEQ ID NO: 14200
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14202 - DNA, 36 bp, Artificial Sequence; identical to SEQ ID NO: 14200
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14203 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 92 to correspond to the nucleotides in an oligonucleotide probe upstream of the discriminating single nucleotide polymorphism.
agtggmtayatrgaagcagargtyatyccagcag

SEQ ID NO: 14204 - DNA, 34 bp, Artificial Sequence; identical to SEQ ID NO: 14203
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14205 - DNA, 34 bp, Artificial Sequence; identical to SEQ ID NO: 14203
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14206 - DNA, 33 bp, Artificial Sequence
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.
gtggmtayatrgaagcagargtyatyccagcag

SEQ ID NO: 14207 - DNA, 33 bp, Artificial Sequence; identical to SEQ ID NO: 14206
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14208 - DNA, 33 bp, Artificial Sequence; identical to SEQ ID NO: 14206
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14209 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.
ygtrgcyagtggmtayatrgaagcagargtyatyccagca

SEQ ID NO: 14210 - DNA, 40 bp, Artificial Sequence; identical to SEQ ID NO: 14209
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14211 - DNA, 40 bp, Artificial Sequence; identical to SEQ ID NO: 14209
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14212 - DNA, 38 bp, Artificial Sequence
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 92 to correspond to the nucleotides in an oligonucleotide probe upstream of the discriminating single nucleotide polymorphism.
trgcyagtggmtayatrgaagcagargtyatyccagca

SEQ ID NO: 14213 - DNA, 38 bp, Artificial Sequence; identical to SEQ ID NO: 14212
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14214 - DNA, 38 bp, Artificial Sequence; identical to SEQ ID NO: 14212
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14215 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.
gcyagtggmtayatrgaagcagargtyatyccagca

SEQ ID NO: 14216 - DNA, 36 bp, Artificial Sequence; identical to SEQ ID NO: 14215
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14217 - DNA, 36 bp, Artificial Sequence; identical to SEQ ID NO: 14215
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14218 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 92 to correspond to the nucleotides in an oligonucleotide probe upstream of the discriminating single nucleotide polymorphism.
cyagtggmtayatrgaagcagargtyatyccagca

SEQ ID NO: 14219 - DNA, 35 bp, Artificial Sequence; identical to SEQ ID NO: 14218
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14220 - DNA, 35 bp, Artificial Sequence; identical to SEQ ID NO: 14218
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14221 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.
agtggmtayatrgaagcagargtyatyccagca

SEQ ID NO: 14222 - DNA, 33 bp, Artificial Sequence; identical to SEQ ID NO: 14221
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14223 - DNA, 33 bp, Artificial Sequence; identical to SEQ ID NO: 14221
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14224 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 92 to correspond to the nucleotides in an oligonucleotide probe upstream of the discriminating single nucleotide polymorphism.
gtggmtayatrgaagcagargtyatyccagca

SEQ ID NO: 14225 - DNA, 32 bp, Artificial Sequence; identical to SEQ ID NO: 14224
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14226 - DNA, 32 bp, Artificial Sequence; identical to SEQ ID NO: 14224
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14227 - DNA, 40 bp, Artificial Sequence; identical to SEQ ID NO: 14191
  Pan degenerate oligonucleotide primer
  primer_bind (1)..(40)
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14228 - DNA, 39 bp, Artificial Sequence; identical to SEQ ID NO: 14194
  Pan degenerate oligonucleotide primer
  primer_bind (1)..(39)
  misc_feature (33)..(39): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14229 - DNA, 37 bp, Artificial Sequence; identical to SEQ ID NO: 14197
  Pan degenerate oligonucleotide primer
  primer_bind (1)..(37)
  misc_feature (31)..(37): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14230 - DNA, 36 bp, Artificial Sequence; identical to SEQ ID NO: 14200
  Pan degenerate oligonucleotide primer
  primer_bind (1)..(36)
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14231 - DNA, 34 bp, Artificial Sequence; identical to SEQ ID NO: 14203
  Pan degenerate oligonucleotide primer
  primer_bind (1)..(34)
  misc_feature (28)..(34): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14232 - DNA, 33 bp, Artificial Sequence; identical to SEQ ID NO: 14206
  Pan degenerate oligonucleotide primer
  primer_bind (1)..(33)
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14233 - DNA, 40 bp, Artificial Sequence; identical to SEQ ID NO: 14209
  Pan degenerate oligonucleotide primer
  primer_bind (1)..(40)
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14234 - DNA, 38 bp, Artificial Sequence; identical to SEQ ID NO: 14212
  Pan degenerate oligonucleotide primer
  primer_bind (1)..(38)
  misc_feature (32)..(38): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14235 - DNA, 36 bp, Artificial Sequence; identical to SEQ ID NO: 14215
  Pan degenerate oligonucleotide primer
  primer_bind (1)..(36)
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14236 - DNA, 35 bp, Artificial Sequence; identical to SEQ ID NO: 14218
  Pan degenerate oligonucleotide primer
  primer_bind (1)..(35)
  misc_feature (29)..(35): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14237 - DNA, 33 bp, Artificial Sequence; identical to SEQ ID NO: 14221
  Pan degenerate oligonucleotide primer
  primer_bind (1)..(33)
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14238 - DNA, 32 bp, Artificial Sequence; identical to SEQ ID NO: 14224
  Pan degenerate oligonucleotide primer
  primer_bind (1)..(32)
  misc_feature (26)..(32): Adaptor region of the pan degenerate sense primer that adapts the probe-binding site upstream of codon 92 to correspond to the nucleotides in an oligonucleotide probe upstream of the discriminating single nucleotide polymorphism.

SEQ ID NO: 14239 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 92 to correspond to the nucleotides in an oligonucleotide probe upstream of the discriminating single nucleotide polymorphism.
gtycaygtrgcyagtggvtayatrgaagcagargtyatcccagca

SEQ ID NO: 14240 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gtrgcyagtggmtayatrgaagcagargtyatyccagcagn

SEQ ID NO: 14241 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 92 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
trgcyagtggmtayatrgaagcagargtyatyccagcagn

SEQ ID NO: 14242 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 92 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
gcyagtggmtayatrgaagcagargtyatyccagcagn

SEQ ID NO: 14243 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
cyagtggmtayatrgaagcagargtyatyccagcagn

SEQ ID NO: 14244 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 92 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
agtggmtayatrgaagcagargtyatyccagcagn

SEQ ID NO: 14245 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
gtggmtayatrgaagcagargtyatyccagcagn

SEQ ID NO: 14246 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 92 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ygtrgcyagtggmtayatrgaagcagargtyatyccagcan

SEQ ID NO: 14247 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 92 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
trgcyagtggmtayatrgaagcagargtyatyccagcan

SEQ ID NO: 14248 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 92 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
gcyagtggmtayatrgaagcagargtyatyccagcan

SEQ ID NO: 14249 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 92 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
cyagtggmtayatrgaagcagargtyatyccagcan

SEQ ID NO: 14250 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 92 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
agtggmtayatrgaagcagargtyatyccagcan

SEQ ID NO: 14251 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 92 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
gtggmtayatrgaagcagargtyatyccagcan

SEQ ID NO: 14252 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 92 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gtycaygtrgcyagtggvtayatrgaagcagargtyatcccagcan

SEQ ID NO: 14253 - DNA, 40 bp, Artificial Sequence
  Pan degenerate oligonucleotide primer
  primer_bind (1)..(40)
  modified_base (3)..(3): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 97 to correspond to the nucleotides in an oligonucleotide probe upstream of the discriminating single nucleotide polymorphism.
yatrgaagcagargtyatyccagcagaracaggrcargar

SEQ ID NO: 14254 - DNA, 40 bp, Artificial Sequence; identical to SEQ ID NO: 14253
  Pan degenerate oligonucleotide primer
  primer_bind (1)..(40)
  modified_base (3)..(3): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14255 - DNA, 40 bp, Artificial Sequence; identical to SEQ ID NO: 14253
  Pan degenerate oligonucleotide primer
  primer_bind (1)..(40)
  modified_base (3)..(3): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14256 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 97 to correspond to the nucleotides in an oligonucleotide probe upstream of the discriminating single nucleotide polymorphism.
gaagcagargtyatyccagcagaracaggrcargar

SEQ ID NO: 14257 - DNA, 36 bp, Artificial Sequence; identical to SEQ ID NO: 14256
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14258 - DNA, 36 bp, Artificial Sequence; identical to SEQ ID NO: 14256
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14259 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 97 to correspond to the nucleotides in an oligonucleotide probe upstream of the discriminating single nucleotide polymorphism.
aagcagargtyatyccagcagaracaggrcargar

SEQ ID NO: 14260 - DNA, 35 bp, Artificial Sequence; identical to SEQ ID NO: 14259
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14261 - DNA, 35 bp, Artificial Sequence; identical to SEQ ID NO: 14259
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14262 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 97 to correspond to the nucleotides in an oligonucleotide probe upstream of the discriminating single nucleotide polymorphism.
gcagargtyatyccagcagaracaggrcargar

SEQ ID NO: 14263 - DNA, 33 bp, Artificial Sequence; identical to SEQ ID NO: 14262
  Pan degenerate oligonucleotide primer
  primer_bind (1)..(33)
  modified_base (1)..(1): base is a locked nucleic acid
  modified_base (5)..(5): base is a locked nucleic acid
  modified_base (8)..(8): base is a locked nucleic acid
  misc_feature (27)..(33): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14264 - DNA, 33 bp, Artificial Sequence; identical to SEQ ID NO: 14262
  Pan degenerate oligonucleotide primer
  primer_bind (1)..(33)
  modified_base (1)..(1): base is a locked nucleic acid
  modified_base (2)..(2): base is a locked nucleic acid
  modified_base (8)..(8): base is a locked nucleic acid
  misc_feature (27)..(33): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14265 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate sense primer that adapts the probe-binding site upstream of codon 97 to correspond to the nucleotides in an oligonucleotide probe upstream of the discriminating single nucleotide polymorphism.
cagargtyatyccagcagaracaggrcargar

SEQ ID NO: 14266 - DNA, 32 bp, Artificial Sequence; identical to SEQ ID NO: 14265
  Pan degenerate oligonucleotide primer
  primer_bind (1)..(32)
  modified_base (1)..(1): base is a locked nucleic acid
  modified_base (7)..(7): base is a locked nucleic acid
  modified_base (10)..(10): base is a locked nucleic acid
  misc_feature (26)..(32): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14267 - DNA, 32 bp, Artificial Sequence; identical to SEQ ID NO: 14265
  Pan degenerate oligonucleotide primer
  primer_bind (1)..(32)
  modified_base (1)..(1): base is a locked nucleic acid
  modified_base (4)..(4): base is a locked nucleic acid
  modified_base (10)..(10): base is a locked nucleic acid
  misc_feature (26)..(32): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14268 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate sense primer that adapts the probe-binding site upstream of codon 97 to correspond to the nucleotides in an oligonucleotide probe upstream of the discriminating single nucleotide polymorphism.
argtyatyccagcagaracaggrcargar

SEQ ID NO: 14269 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  misc_feature (23)..(29): Adaptor region of the pan degenerate sense primer that adapts the probe-binding site upstream of codon 97 to correspond to the nucleotides in an oligonucleotide probe upstream of the discriminating single nucleotide polymorphism.
argtyatyccagcagaracaggrcargar

SEQ ID NO: 14270 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  misc_feature (23)..(29): Adaptor region of the pan degenerate sense primer that adapts the probe-binding site upstream of codon 97 to correspond to the nucleotides in an oligonucleotide probe upstream of the discriminating single nucleotide polymorphism.
argtyatyccagcagaracaggrcargar

SEQ ID NO: 14271 - DNA, 40 bp, Artificial Sequence; identical to SEQ ID NO: 14253
  Pan degenerate oligonucleotide primer
  primer_bind (1)..(40)
  misc_feature (34)..(40): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14272 - DNA, 36 bp, Artificial Sequence; identical to SEQ ID NO: 14256
  Pan degenerate oligonucleotide primer
  primer_bind (1)..(36)
  misc_feature (30)..(36): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14273 - DNA, 35 bp, Artificial Sequence; identical to SEQ ID NO: 14259
  Pan degenerate oligonucleotide primer
  primer_bind (1)..(35)
  misc_feature (29)..(35): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14274 - DNA, 33 bp, Artificial Sequence; identical to SEQ ID NO: 14262
  Pan degenerate oligonucleotide primer
  primer_bind (1)..(33)
  misc_feature (27)..(33): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14275 - DNA, 32 bp, Artificial Sequence; identical to SEQ ID NO: 14265
  Pan degenerate oligonucleotide primer
  primer_bind (1)..(32)
  misc_feature (26)..(32): Adaptor region of the pan degenerate sense primer that adapts the probe-binding site upstream of codon 97 to correspond to the nucleotides in an oligonucleotide probe upstream of the discriminating single nucleotide polymorphism.

SEQ ID NO: 14276 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 97 to correspond to the nucleotides in an oligonucleotide probe upstream of the discriminating single nucleotide polymorphism.
argtyatyccagcagaracaggrcargar

SEQ ID NO: 14277 - DNA, 46 bp, Artificial Sequence
  Pan degenerate oligonucleotide primer
  primer_bind (1)..(46)
  misc_feature (40)..(46): Adaptor region of the pan degenerate sense primer that adapts the probe-binding site upstream of codon 97 to correspond to the nucleotides in an oligonucleotide probe upstream of the discriminating single nucleotide polymorphism.
tggvtayatrgaagcagargtyatyccagcagaracaggacaggaa

SEQ ID NO: 14278 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 97 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
yatrgaagcagargtyatyccagcagaracaggrcargarn

SEQ ID NO: 14279 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 97 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
gaagcagargtyatyccagcagaracaggrcargarn

SEQ ID NO: 14280 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 97 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
aagcagargtyatyccagcagaracaggrcargarn

SEQ ID NO: 14281 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 97 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
gcagargtyatyccagcagaracaggrcargarn

SEQ ID NO: 14282 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 97 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
cagargtyatyccagcagaracaggrcargarn

SEQ ID NO: 14283 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 97 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
argtyatyccagcagaracaggrcargarn

SEQ ID NO: 14284 - DNA, 47 bp, Artificial Sequence
  Pan degenerate oligonucleotide primer
  primer_bind (1)..(47)
  misc_feature (40)..(46): Adaptor region of the pan degenerate sense primer that adapts the probe-binding site upstream of codon 97 to correspond to the nucleotides in an oligonucleotide probe upstream of the discriminating single nucleotide polymorphism.
  modified_base (47)..(47): base is a locked nucleic acid
  misc_feature (47)..(47): n is a, c, g, or t
tggvtayatrgaagcagargtyatyccagcagaracaggacaggaan

SEQ ID NO: 14285 - DNA, 40 bp, Artificial Sequence
  Pan degenerate oligonucleotide primer
  primer_bind (1)..(40)
  modified_base (3)..(3): base is a locked nucleic acid
  modified_base (5)..(5): base is a locked nucleic acid
  modified_base (11)..(11): base is a locked nucleic acid
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.
agcaggaagrtggccagtvaarryartacayacagayaat

SEQ ID NO: 14286 - DNA, 40 bp, Artificial Sequence; identical to SEQ ID NO: 14285
  Pan degenerate oligonucleotide primer
  primer_bind (1)..(40)
  modified_base (3)..(3): base is a locked nucleic acid
  modified_base (11)..(11): base is a locked nucleic acid
  modified_base (12)..(12): base is a locked nucleic acid
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14287 - DNA, 40 bp, Artificial Sequence; identical to SEQ ID NO: 14285
  Pan degenerate oligonucleotide primer
  primer_bind (1)..(40)
  modified_base (3)..(3): base is a locked nucleic acid
  modified_base (5)..(5): base is a locked nucleic acid
  modified_base (12)..(12): base is a locked nucleic acid
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14288 - DNA, 36 bp, Artificial Sequence
  Pan degenerate oligonucleotide primer
  primer_bind (1)..(36)
  modified_base (1)..(1): base is a locked nucleic acid
  modified_base (7)..(7): base is a locked nucleic acid
  modified_base (8)..(8): base is a locked nucleic acid
  misc_feature (30)..(36): Adaptor region of the pan degenerate sense primer that adapts the probe-binding site upstream of codon 118 to correspond to the nucleotides in an oligonucleotide probe upstream of the discriminating single nucleotide polymorphism.
ggaagrtggccagtvaarryartacayacagayaat

SEQ ID NO: 14289 - DNA, 36 bp, Artificial Sequence; identical to SEQ ID NO: 14288
  Pan degenerate oligonucleotide primer
  primer_bind (1)..(36)
  modified_base (1)..(1): base is a locked nucleic acid
  modified_base (8)..(8): base is a locked nucleic acid
  modified_base (9)..(9): base is a locked nucleic acid
  misc_feature (30)..(36): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14290 - DNA, 36 bp, Artificial Sequence; identical to SEQ ID NO: 14288
  Pan degenerate oligonucleotide primer
  primer_bind (1)..(36)
  modified_base (1)..(1): base is a locked nucleic acid
  modified_base (7)..(7): base is a locked nucleic acid
  modified_base (9)..(9): base is a locked nucleic acid
  misc_feature (30)..(36): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14291 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (3)..(3): base is a locked nucleic acid
  misc_feature (24)..(30): Adaptor region of the pan degenerate sense primer that adapts the probe-binding site upstream of codon 118 to correspond to the nucleotides in an oligonucleotide probe upstream of the discriminating single nucleotide polymorphism.
tggccagtvaarryartacayacagayaat

SEQ ID NO: 14292 - DNA, 30 bp, Artificial Sequence; identical to SEQ ID NO: 14291
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14293 - DNA, 30 bp, Artificial Sequence; identical to SEQ ID NO: 14291
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14294 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (3)..(3): base is a locked nucleic acid
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
ggccagtvaarryartacayacagayaat

SEQ ID NO: 14295 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
ggccagtvaarryartacayacagayaat

SEQ ID NO: 14296 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
ggccagtvaarryartacayacagayaat

SEQ ID NO: 14297 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (3)..(3): base is a locked nucleic acid
  misc_feature (22)..(28): Adaptor region of the pan degenerate sense primer that adapts the probe-binding site upstream of codon 118 to correspond to the nucleotides in an oligonucleotide probe upstream of the discriminating single nucleotide polymorphism.
gccagtvaarryartacayacagayaat

SEQ ID NO: 14298 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (6)..(6): base is a locked nucleic acid
  misc_feature (22)..(28): Adaptor region of the pan degenerate sense primer that adapts the probe-binding site upstream of codon 118 to correspond to the nucleotides in an oligonucleotide probe upstream of the discriminating single nucleotide polymorphism.
gccagtvaarryartacayacagayaat

SEQ ID NO: 14299 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (6)..(6): base is a locked nucleic acid
  misc_feature (22)..(28): Adaptor region of the pan degenerate sense primer that adapts the probe-binding site upstream of codon 118 to correspond to the nucleotides in an oligonucleotide probe upstream of the discriminating single nucleotide polymorphism.
gccagtvaarryartacayacagayaat

SEQ ID NO: 14300 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate sense primer that adapts the probe-binding site upstream of codon 118 to correspond to the nucleotides in an oligonucleotide probe upstream of the discriminating single nucleotide polymorphism.
ccagtvaarryartacayacagayaat

SEQ ID NO: 14301 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (14)..(14): base is a locked nucleic acid
  misc_feature (21)..(27): Adaptor region of the pan degenerate sense primer that adapts the probe-binding site upstream of codon 118 to correspond to the nucleotides in an oligonucleotide probe upstream of the discriminating single nucleotide polymorphism.
ccagtvaarryartacayacagayaat

SEQ ID NO: 14302 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (14)..(14): base is a locked nucleic acid
  misc_feature (21)..(27): Adaptor region of the pan degenerate sense primer that adapts the probe-binding site upstream of codon 118 to correspond to the nucleotides in an oligonucleotide probe upstream of the discriminating single nucleotide polymorphism.
ccagtvaarryartacayacagayaat

SEQ ID NO: 14303 - DNA, 40 bp, Artificial Sequence; identical to SEQ ID NO: 14285
  Pan degenerate oligonucleotide primer
  primer_bind (1)..(40)
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14304 - DNA, 36 bp, Artificial Sequence; identical to SEQ ID NO: 14288
  Pan degenerate oligonucleotide primer
  primer_bind (1)..(36)
  misc_feature (30)..(36): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14305 - DNA, 30 bp, Artificial Sequence; identical to SEQ ID NO: 14291
  Pan degenerate oligonucleotide primer
  primer_bind (1)..(30)
  misc_feature (24)..(30): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 14306 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
ggccagtvaarryartacayacagayaat

SEQ ID NO: 14307 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 118 to correspond to the nucleotides in an oligonucleotide probe upstream of the discriminating single nucleotide polymorphism.
gccagtvaarryartacayacagayaat

SEQ ID NO: 14308 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 118 to correspond to the nucleotides in an oligonucleotide probe upstream of the discriminating single nucleotide polymorphism.
ccagtvaarryartacayacagayaat

SEQ ID NO: 14309 - DNA, 46 bp, Artificial Sequence
  Pan degenerate oligonucleotide primer
  primer_bind (1)..(46)
  misc_feature (40)..(46): Adaptor region of the pan degenerate sense primer that adapts the probe-binding site upstream of codon 118 to correspond to the nucleotides in an oligonucleotide probe upstream of the discriminating single nucleotide polymorphism.
aaarytagcaggragrtggccagtvararyartacayacagacaat

SEQ ID NO: 14310 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
agcaggaagrtggccagtvaarryartacayacagayaatn

SEQ ID NO: 14311 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 118 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ggaagrtggccagtvaarryartacayacagayaatn

SEQ ID NO: 14312 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 118 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
tggccagtvaarryartacayacagayaatn

SEQ ID NO: 14313 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
ggccagtvaarryartacayacagayaatn

SEQ ID NO: 14314 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 118 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
gccagtvaarryartacayacagayaatn

SEQ ID NO: 14315 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 118 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
ccagtvaarryartacayacagayaatn

SEQ ID NO: 14316 - DNA, 47 bp, Artificial Sequence
  Pan degenerate oligonucleotide primer
  primer_bind (1)..(47)
  misc_feature (40)..(46): Adaptor region of the pan degenerate sense primer that adapts the probe-binding site upstream of codon 118 to correspond to the nucleotides in an oligonucleotide probe upstream of the discriminating single nucleotide polymorphism.
  modified_base (47)..(47): base is a locked nucleic acid
  misc_feature (47)..(47): n is a, c, g, or t
aaarytagcaggragrtggccagtvararyartacayacagacaatn

SEQ ID NO: 14317 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (3)..(3): base is a locked nucleic acid
  misc_feature (34)..(40): Adaptor region of the pan degenerate sense primer that adapts the probe-binding site upstream of codon 121 to correspond to the nucleotides in an oligonucleotide probe upstream of the discriminating single nucleotide polymorphism.
tggccagtvaarryartacayacagayaatggymsyaayt

SEQ ID NO: 14318 - DNA, 40 bp, Artificial Sequence; identical to SEQ ID NO: 14317
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14319 - DNA, 40 bp, Artificial Sequence; identical to SEQ ID NO: 14317
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14320 - DNA, 39 bp, Artificial Sequence
  Pan degenerate oligonucleotide primer
  primer_bind (1)..(39)
  modified_base (1)..(1): base is a locked nucleic acid
  modified_base (2)..(2): base is a locked nucleic acid
  modified_base (3)..(3): base is a locked nucleic acid
  misc_feature (33)..(39): Adaptor region of the pan degenerate sense primer that adapts the probe-binding site upstream of codon 121 to correspond to the nucleotides in an oligonucleotide probe upstream of the discriminating single nucleotide polymorphism.
ggccagtvaarryartacayacagayaatggymsyaayt

SEQ ID NO: 14321 - DNA, 39 bp, Artificial Sequence; identical to SEQ ID NO: 14320
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14322 - DNA, 39 bp, Artificial Sequence; identical to SEQ ID NO: 14320
  Pan degenerate oligonucleotide primer
  primer_bind (1)..(39)
  modified_base (1)..(1): base is a locked nucleic acid
  modified_base (2)..(2): base is a locked nucleic acid
  modified_base (4)..(4): base is a locked nucleic acid
  misc_feature (33)..(39): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14323 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (3)..(3): base is a locked nucleic acid
  misc_feature (32)..(38): Adaptor region of the pan degenerate sense primer that adapts the probe-binding site upstream of codon 121 to correspond to the nucleotides in an oligonucleotide probe upstream of the discriminating single nucleotide polymorphism.
gccagtvaarryartacayacagayaatggymsyaayt

SEQ ID NO: 14324 - DNA, 38 bp, Artificial Sequence; identical to SEQ ID NO: 14323
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14325 - DNA, 38 bp, Artificial Sequence; identical to SEQ ID NO: 14323
  Pan degenerate oligonucleotide primer
  primer_bind (1)..(38)
  modified_base (1)..(1): base is a locked nucleic acid
  modified_base (2)..(2): base is a locked nucleic acid
  modified_base (6)..(6): base is a locked nucleic acid
  misc_feature (32)..(38): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14326 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 121 to correspond to the nucleotides in an oligonucleotide probe upstream of the discriminating single nucleotide polymorphism.
ccagtvaarryartacayacagayaatggymsyaayt

SEQ ID NO: 14327 - DNA, 37 bp, Artificial Sequence; identical to SEQ ID NO: 14326
  Pan degenerate oligonucleotide primer
  primer_bind (1)..(37)
  modified_base (1)..(1): base is a locked nucleic acid
  modified_base (5)..(5): base is a locked nucleic acid
  modified_base (14)..(14): base is a locked nucleic acid
  misc_feature (31)..(37): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14328 - DNA, 37 bp, Artificial Sequence; identical to SEQ ID NO: 14326
  Pan degenerate oligonucleotide primer
  primer_bind (1)..(37)
  modified_base (1)..(1): base is a locked nucleic acid
  modified_base (2)..(2): base is a locked nucleic acid
  modified_base (14)..(14): base is a locked nucleic acid
  misc_feature (31)..(37): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14329 - DNA, 36 bp, Artificial Sequence
  Pan degenerate oligonucleotide primer
  primer_bind (1)..(36)
  modified_base (1)..(1): base is a locked nucleic acid
  modified_base (4)..(4): base is a locked nucleic acid
  modified_base (13)..(13): base is a locked nucleic acid
  misc_feature (30)..(36): Adaptor region of the pan degenerate sense primer that adapts the probe-binding site upstream of codon 121 to correspond to the nucleotides in an oligonucleotide probe upstream of the discriminating single nucleotide polymorphism.
cagtvaarryartacayacagayaatggymsyaayt

SEQ ID NO: 14330 - DNA, 36 bp, Artificial Sequence; identical to SEQ ID NO: 14329
  Pan degenerate oligonucleotide primer
  primer_bind (1)..(36)
  modified_base (1)..(1): base is a locked nucleic acid
  modified_base (13)..(13): base is a locked nucleic acid
  modified_base (15)..(15): base is a locked nucleic acid
  misc_feature (30)..(36): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14331 - DNA, 36 bp, Artificial Sequence; identical to SEQ ID NO: 14329
  Pan degenerate oligonucleotide primer
  primer_bind (1)..(36)
  modified_base (1)..(1): base is a locked nucleic acid
  modified_base (4)..(4): base is a locked nucleic acid
  modified_base (15)..(15): base is a locked nucleic acid
  misc_feature (30)..(36): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14332 - DNA, 33 bp, Artificial Sequence
  Pan degenerate oligonucleotide primer
  primer_bind (1)..(33)
  modified_base (1)..(1): base is a locked nucleic acid
  modified_base (10)..(10): base is a locked nucleic acid
  modified_base (12)..(12): base is a locked nucleic acid
  misc_feature (27)..(33): Adaptor region of the pan degenerate sense primer that adapts the probe-binding site upstream of codon 121 to correspond to the nucleotides in an oligonucleotide probe upstream of the discriminating single nucleotide polymorphism.
tvaarryartacayacagayaatggymsyaayt

SEQ ID NO: 14333 - DNA, 33 bp, Artificial Sequence; identical to SEQ ID NO: 14332
  Pan degenerate oligonucleotide primer
  primer_bind (1)..(33)
  modified_base (1)..(1): base is a locked nucleic acid
  modified_base (12)..(12): base is a locked nucleic acid
  modified_base (13)..(13): base is a locked nucleic acid
  misc_feature (27)..(33): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14334 - DNA, 33 bp, Artificial Sequence; identical to SEQ ID NO: 14332
  Pan degenerate oligonucleotide primer
  primer_bind (1)..(33)
  modified_base (1)..(1): base is a locked nucleic acid
  modified_base (10)..(10): base is a locked nucleic acid
  modified_base (13)..(13): base is a locked nucleic acid
  misc_feature (27)..(33): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14335 - DNA, 40 bp, Artificial Sequence; identical to SEQ ID NO: 14317
  Pan degenerate oligonucleotide primer
  primer_bind (1)..(40)
  misc_feature (34)..(40): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14336 - DNA, 39 bp, Artificial Sequence; identical to SEQ ID NO: 14320
  Pan degenerate oligonucleotide primer
  primer_bind (1)..(39)
  misc_feature (33)..(39): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14337 - DNA, 38 bp, Artificial Sequence; identical to SEQ ID NO: 14323
  Pan degenerate oligonucleotide primer
  primer_bind (1)..(38)
  misc_feature (32)..(38): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14338 - DNA, 37 bp, Artificial Sequence; identical to SEQ ID NO: 14326
  Pan degenerate oligonucleotide primer
  primer_bind (1)..(37)
  misc_feature (31)..(37): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14339 - DNA, 36 bp, Artificial Sequence; identical to SEQ ID NO: 14329
  Pan degenerate oligonucleotide primer
  primer_bind (1)..(36)
  misc_feature (30)..(36): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14340 - DNA, 33 bp, Artificial Sequence; identical to SEQ ID NO: 14332
  Pan degenerate oligonucleotide primer
  primer_bind (1)..(33)
  misc_feature (27)..(33): Adaptor region of the pan degenerate sense primer that adapts the probe-binding site upstream of codon 121 to correspond to the nucleotides in an oligonucleotide probe upstream of the discriminating single nucleotide polymorphism.

SEQ ID NO: 14341 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 121 to correspond to the nucleotides in an oligonucleotide probe upstream of the discriminating single nucleotide polymorphism.
ggragrtggccagtvararyartacayacagayaayggyagcaat

SEQ ID NO: 14342 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 121 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
tggccagtvaarryartacayacagayaatggymsyaaytn

SEQ ID NO: 14343 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 121 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
ggccagtvaarryartacayacagayaatggymsyaaytn

SEQ ID NO: 14344 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 121 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
gccagtvaarryartacayacagayaatggymsyaaytn

SEQ ID NO: 14345 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 121 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ccagtvaarryartacayacagayaatggymsyaaytn

SEQ ID NO: 14346 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 121 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
cagtvaarryartacayacagayaatggymsyaaytn

SEQ ID NO: 14347 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 121 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tvaarryartacayacagayaatggymsyaaytn

SEQ ID NO: 14348 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 121 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ggragrtggccagtvararyartacayacagayaayggyagcaatn

SEQ ID NO: 14349 - DNA, 40 bp, Artificial Sequence
  Pan degenerate oligonucleotide primer
  primer_bind (1)..(40)
  modified_base (10)..(10): base is a locked nucleic acid
  modified_base (11)..(11): base is a locked nucleic acid
  modified_base (13)..(13): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
rcrgthaargchgcmtgytggtgggcvrrbrtcmmrcarg

SEQ ID NO: 14350 - DNA, 40 bp, Artificial Sequence; identical to SEQ ID NO: 14349
  Pan degenerate oligonucleotide primer
  primer_bind (1)..(40)
  modified_base (10)..(10): base is a locked nucleic acid
  modified_base (13)..(13): base is a locked nucleic acid
  modified_base (14)..(14): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14351 - DNA, 40 bp, Artificial Sequence; identical to SEQ ID NO: 14349
  Pan degenerate oligonucleotide primer
  primer_bind (1)..(40)
  modified_base (10)..(10): base is a locked nucleic acid
  modified_base (11)..(11): base is a locked nucleic acid
  modified_base (14)..(14): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14352 - DNA, 30 bp, Artificial Sequence
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate sense primer that adapts the probe-binding site upstream of codon 138 to correspond to the nucleotides in an oligonucleotide probe upstream of the discriminating single nucleotide polymorphism.
chgcmtgytggtgggcvrrbrtcmmrcarg

SEQ ID NO: 14353 - DNA, 30 bp, Artificial Sequence; identical to SEQ ID NO: 14352
  Pan degenerate oligonucleotide primer
  primer_bind (1)..(30)
  modified_base (1)..(1): base is a locked nucleic acid
  modified_base (4)..(4): base is a locked nucleic acid
  modified_base (6)..(6): base is a locked nucleic acid
  misc_feature (24)..(30): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14354 - DNA, 30 bp, Artificial Sequence; identical to SEQ ID NO: 14352
  Pan degenerate oligonucleotide primer
  primer_bind (1)..(30)
  modified_base (1)..(1): base is a locked nucleic acid
  modified_base (3)..(3): base is a locked nucleic acid
  modified_base (6)..(6): base is a locked nucleic acid
  misc_feature (24)..(30): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14355 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (4)..(4): base is a locked nucleic acid
  misc_feature (22)..(28): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcarg

SEQ ID NO: 14356 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (5)..(5): base is a locked nucleic acid
  misc_feature (22)..(28): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcarg

SEQ ID NO: 14357 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (5)..(5): base is a locked nucleic acid
  misc_feature (22)..(28): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcarg

SEQ ID NO: 14358 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (4)..(4): base is a locked nucleic acid
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcarg

SEQ ID NO: 14359 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (6)..(6): base is a locked nucleic acid
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcarg

SEQ ID NO: 14360 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (6)..(6): base is a locked nucleic acid
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcarg

SEQ ID NO: 14361 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (4)..(4): base is a locked nucleic acid
  misc_feature (19)..(25): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcarg

SEQ ID NO: 14362 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (5)..(5): base is a locked nucleic acid
  misc_feature (19)..(25): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcarg

SEQ ID NO: 14363 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (5)..(5): base is a locked nucleic acid
  misc_feature (19)..(25): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcarg

SEQ ID NO: 14364 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (4)..(4): base is a locked nucleic acid
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcarg

SEQ ID NO: 14365 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (5)..(5): base is a locked nucleic acid
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcarg

SEQ ID NO: 14366 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (5)..(5): base is a locked nucleic acid
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcarg

SEQ ID NO: 14367 - DNA, 40 bp, Artificial Sequence
  Pan degenerate oligonucleotide primer
  primer_bind (1)..(40)
  modified_base (11)..(11): base is a locked nucleic acid
  modified_base (12)..(12): base is a locked nucleic acid
  modified_base (14)..(14): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
trcrgthaargchgcmtgytggtgggcvrrbrtcmmrcar

SEQ ID NO: 14368 - DNA, 40 bp, Artificial Sequence; identical to SEQ ID NO: 14367
  Pan degenerate oligonucleotide primer
  primer_bind (1)..(40)
  modified_base (11)..(11): base is a locked nucleic acid
  modified_base (14)..(14): base is a locked nucleic acid
  modified_base (15)..(15): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14369 - DNA, 40 bp, Artificial Sequence; identical to SEQ ID NO: 14367
  Pan degenerate oligonucleotide primer
  primer_bind (1)..(40)
  modified_base (11)..(11): base is a locked nucleic acid
  modified_base (12)..(12): base is a locked nucleic acid
  modified_base (15)..(15): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14370 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 138 to correspond to the nucleotides in an oligonucleotide probe upstream of the discriminating single nucleotide polymorphism.
chgcmtgytggtgggcvrrbrtcmmrcar

SEQ ID NO: 14371 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate sense primer that adapts the probe-binding site upstream of codon 138 to correspond to the nucleotides in an oligonucleotide probe upstream of the discriminating single nucleotide polymorphism.
chgcmtgytggtgggcvrrbrtcmmrcar

SEQ ID NO: 14372 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate sense primer that adapts the probe-binding site upstream of codon 138 to correspond to the nucleotides in an oligonucleotide probe upstream of the discriminating single nucleotide polymorphism.
chgcmtgytggtgggcvrrbrtcmmrcar

SEQ ID NO: 14373 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (4)..(4): base is a locked nucleic acid
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcar

SEQ ID NO: 14374 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcar

SEQ ID NO: 14375 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcar

SEQ ID NO: 14376 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcar

SEQ ID NO: 14377 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (6)..(6): base is a locked nucleic acid
  misc_feature (20)..(26): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcar

SEQ ID NO: 14378 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (6)..(6): base is a locked nucleic acid
  misc_feature (20)..(26): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcar

SEQ ID NO: 14379 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcar

SEQ ID NO: 14380 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (5)..(5): base is a locked nucleic acid
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcar

SEQ ID NO: 14381 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (5)..(5): base is a locked nucleic acid
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcar

SEQ ID NO: 14382 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (4)..(4): base is a locked nucleic acid
  misc_feature (17)..(23): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcar

SEQ ID NO: 14383 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (5)..(5): base is a locked nucleic acid
  misc_feature (17)..(23): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcar

SEQ ID NO: 14384 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (5)..(5): base is a locked nucleic acid
  misc_feature (17)..(23): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcar

SEQ ID NO: 14385 - DNA, 40 bp, Artificial Sequence; identical to SEQ ID NO: 14349
  Pan degenerate oligonucleotide primer
  primer_bind (1)..(40)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14386 - DNA, 30 bp, Artificial Sequence; identical to SEQ ID NO: 14352
  Pan degenerate oligonucleotide primer
  primer_bind (1)..(30)
  misc_feature (24)..(30): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14387 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcarg

SEQ ID NO: 14388 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcarg

SEQ ID NO: 14389 - DNA, 25 bp, Artificial Sequence
  Pan degenerate oligonucleotide primer
  primer_bind (1)..(25)
  misc_feature (19)..(25): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcarg

SEQ ID NO: 14390 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcarg

SEQ ID NO: 14391 - DNA, 40 bp, Artificial Sequence; identical to SEQ ID NO: 14367
  Pan degenerate oligonucleotide primer
  primer_bind (1)..(40)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 14392 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 138 to correspond to the nucleotides in an oligonucleotide probe upstream of the discriminating single nucleotide polymorphism.
chgcmtgytggtgggcvrrbrtcmmrcar

SEQ ID NO: 14393 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
gcmtgytggtgggcvrrbrtcmmrcar

SEQ ID NO: 14394 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 138 to correspond to the nucleotides in an oligonucleotide probe upstream of the discriminating single nucleotide polymorphism.
cmtgytggtgggcvrrbrtcmmrcar

SEQ ID NO: 14395 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
tgytggtgggcvrrbrtcmmrcar

SEQ ID NO: 14396 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 138 to correspond to the nucleotides in an oligonucleotide probe upstream of the discriminating single nucleotide polymorphism.
gytggtgggcvrrbrtcmmrcar

SEQ ID NO: 14397 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 138 to correspond to the nucleotides in an oligonucleotide probe upstream of the discriminating single nucleotide polymorphism.
agyrmyrcrgthaargchgcmtgytggtgggcvrrdrtyaaacag

SEQ ID NO: 14398 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rcrgthaargchgcmtgytggtgggcvrrbrtcmmrcargn

SEQ ID NO: 14399 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 138 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
chgcmtgytggtgggcvrrbrtcmmrcargn

SEQ ID NO: 14400 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 138 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
gcmtgytggtgggcvrrbrtcmmrcargn

SEQ ID NO: 14401 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
cmtgytggtgggcvrrbrtcmmrcargn

SEQ ID NO: 14402 - DNA, 26 bp, Artificial Sequence
  Pan degenerate oligonucleotide primer
  primer_bind (1)..(26)
  misc_feature (19)..(25): Adaptor region of the pan degenerate sense primer that adapts the probe-binding site upstream of codon 138 to correspond to the nucleotides in an oligonucleotide probe upstream of the discriminating single nucleotide polymorphism.
  modified_base (26)..(26): base is a locked nucleic acid
  misc_feature (26)..(26): n is a, c, g, or t
tgytggtgggcvrrbrtcmmrcargn

SEQ ID NO: 14403 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
gytggtgggcvrrbrtcmmrcargn

SEQ ID NO: 14404 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
trcrgthaargchgcmtgytggtgggcvrrbrtcmmrcarn

SEQ ID NO: 14405 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 138 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
chgcmtgytggtgggcvrrbrtcmmrcarn

SEQ ID NO: 14406 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 138 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
gcmtgytggtgggcvrrbrtcmmrcarn

SEQ ID NO: 14407 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 138 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
cmtgytggtgggcvrrbrtcmmrcarn

SEQ ID NO: 14408 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 138 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
tgytggtgggcvrrbrtcmmrcarn

SEQ ID NO: 14409 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 138 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
gytggtgggcvrrbrtcmmrcarn

SEQ ID NO: 14410 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 138 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
agyrmyrcrgthaargchgcmtgytggtgggcvrrdrtyaaacagn

SEQ ID NO: 14411 - DNA, 40 bp, Artificial Sequence
  Pan degenerate oligonucleotide primer
  primer_bind (1)..(40)
  modified_base (4)..(4): base is a locked nucleic acid
  modified_base (5)..(5): base is a locked nucleic acid
  modified_base (7)..(7): base is a locked nucleic acid
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.
aargchgcmtgytggtgggcvrrbrtcmmrcargaatttg

SEQ ID NO: 14412 - DNA, 40 bp, Artificial Sequence; identical to SEQ ID NO: 14411
  Pan degenerate oligonucleotide primer
  primer_bind (1)..(40)
  modified_base (4)..(4): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14413 - DNA, 40 bp, Artificial Sequence; identical to SEQ ID NO: 14411
  Pan degenerate oligonucleotide primer
  primer_bind (1)..(40)
  modified_base (4)..(4): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14414 - DNA, 36 bp, Artificial Sequence
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 140 to correspond to the nucleotides in an oligonucleotide probe upstream of the discriminating single nucleotide polymorphism.
chgcmtgytggtgggcvrrbrtcmmrcargaatttg

SEQ ID NO: 14415 - DNA, 36 bp, Artificial Sequence; identical to SEQ ID NO: 14414
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14416 - DNA, 36 bp, Artificial Sequence; identical to SEQ ID NO: 14414
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14417 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 140 to correspond to the nucleotides in an oligonucleotide probe upstream of the discriminating single nucleotide polymorphism.
gcmtgytggtgggcvrrbrtcmmrcargaatttg

SEQ ID NO: 14418 - DNA, 34 bp, Artificial Sequence; identical to SEQ ID NO: 14417
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14419 - DNA, 34 bp, Artificial Sequence; identical to SEQ ID NO: 14417
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14420 - DNA, 33 bp, Artificial Sequence
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.
cmtgytggtgggcvrrbrtcmmrcargaatttg

SEQ ID NO: 14421 - DNA, 33 bp, Artificial Sequence; identical to SEQ ID NO: 14420
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14422 - DNA, 33 bp, Artificial Sequence; identical to SEQ ID NO: 14420
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14423 - DNA, 31 bp, Artificial Sequence
  Pan degenerate oligonucleotide primer
  primer_bind (1)..(31)
  modified_base (1)..(1): base is a locked nucleic acid
  modified_base (2)..(2): base is a locked nucleic acid
  modified_base (4)..(4): base is a locked nucleic acid
  misc_feature (25)..(31): Adaptor region of the pan degenerate sense primer that adapts the probe-binding site upstream of codon 140 to correspond to the nucleotides in an oligonucleotide probe upstream of the discriminating single nucleotide polymorphism.
tgytggtgggcvrrbrtcmmrcargaatttg

SEQ ID NO: 14424 - DNA, 31 bp, Artificial Sequence; identical to SEQ ID NO: 14423
  Pan degenerate oligonucleotide primer
  primer_bind (1)..(31)
  modified_base (1)..(1): base is a locked nucleic acid
  modified_base (4)..(4): base is a locked nucleic acid
  modified_base (5)..(5): base is a locked nucleic acid
  misc_feature (25)..(31): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14425 - DNA, 31 bp, Artificial Sequence; identical to SEQ ID NO: 14423
  Pan degenerate oligonucleotide primer
  primer_bind (1)..(31)
  modified_base (1)..(1): base is a locked nucleic acid
  modified_base (2)..(2): base is a locked nucleic acid
  modified_base (5)..(5): base is a locked nucleic acid
  misc_feature (25)..(31): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14426 - DNA, 30 bp, Artificial Sequence
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.
gytggtgggcvrrbrtcmmrcargaatttg

SEQ ID NO: 14427 - DNA, 30 bp, Artificial Sequence; identical to SEQ ID NO: 14426
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14428 - DNA, 30 bp, Artificial Sequence; identical to SEQ ID NO: 14426
  Pan degenerate oligonucleotide primer
  primer_bind (1)..(30)
  modified_base (1)..(1): base is a locked nucleic acid
  modified_base (3)..(3): base is a locked nucleic acid
  modified_base (5)..(5): base is a locked nucleic acid
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14429 - DNA, 40 bp, Artificial Sequence
  Pan degenerate oligonucleotide primer
  primer_bind (1)..(40)
  modified_base (5)..(5): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.
haargchgcmtgytggtgggcvrrbrtcmmrcargaattt

SEQ ID NO: 14430 - DNA, 40 bp, Artificial Sequence; identical to SEQ ID NO: 14429
  Pan degenerate oligonucleotide primer
  primer_bind (1)..(40)
  modified_base (5)..(5): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14431 - DNA, 40 bp, Artificial Sequence; identical to SEQ ID NO: 14429
  Pan degenerate oligonucleotide primer
  primer_bind (1)..(40)
  modified_base (5)..(5): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14432 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 140 to correspond to the nucleotides in an oligonucleotide probe upstream of the discriminating single nucleotide polymorphism.
chgcmtgytggtgggcvrrbrtcmmrcargaattt

SEQ ID NO: 14433 - DNA, 35 bp, Artificial Sequence; identical to SEQ ID NO: 14432
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14434 - DNA, 35 bp, Artificial Sequence; identical to SEQ ID NO: 14432
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14435 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.
gcmtgytggtgggcvrrbrtcmmrcargaattt

SEQ ID NO: 14436 - DNA, 33 bp, Artificial Sequence; identical to SEQ ID NO: 14435
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14437 - DNA, 33 bp, Artificial Sequence; identical to SEQ ID NO: 14435
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14438 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 140 to correspond to the nucleotides in an oligonucleotide probe upstream of the discriminating single nucleotide polymorphism.
cmtgytggtgggcvrrbrtcmmrcargaattt

SEQ ID NO: 14439 - DNA, 32 bp, Artificial Sequence; identical to SEQ ID NO: 14438
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14440 - DNA, 32 bp, Artificial Sequence; identical to SEQ ID NO: 14438
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14441 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.
tgytggtgggcvrrbrtcmmrcargaattt

SEQ ID NO: 14442 - DNA, 30 bp, Artificial Sequence; identical to SEQ ID NO: 14441
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14443 - DNA, 30 bp, Artificial Sequence; identical to SEQ ID NO: 14441
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14444 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 140 to correspond to the nucleotides in an oligonucleotide probe upstream of the discriminating single nucleotide polymorphism.
gytggtgggcvrrbrtcmmrcargaattt

SEQ ID NO: 14445 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate sense primer that adapts the probe-binding site upstream of codon 140 to correspond to the nucleotides in an oligonucleotide probe upstream of the discriminating single nucleotide polymorphism.
gytggtgggcvrrbrtcmmrcargaattt

SEQ ID NO: 14446 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (5)..(5): base is a locked nucleic acid
  misc_feature (23)..(29): Adaptor region of the pan degenerate sense primer that adapts the probe-binding site upstream of codon 140 to correspond to the nucleotides in an oligonucleotide probe upstream of the discriminating single nucleotide polymorphism.
gytggtgggcvrrbrtcmmrcargaattt

SEQ ID NO: 14447 - DNA, 40 bp, Artificial Sequence; identical to SEQ ID NO: 14411
  Pan degenerate oligonucleotide primer
  primer_bind (1)..(40)
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14448 - DNA, 36 bp, Artificial Sequence; identical to SEQ ID NO: 14414
  Pan degenerate oligonucleotide primer
  primer_bind (1)..(36)
  misc_feature (30)..(36): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14449 - DNA, 34 bp, Artificial Sequence; identical to SEQ ID NO: 14417
  Pan degenerate oligonucleotide primer
  primer_bind (1)..(34)
  misc_feature (28)..(34): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14450 - DNA, 33 bp, Artificial Sequence; identical to SEQ ID NO: 14420
  Pan degenerate oligonucleotide primer
  primer_bind (1)..(33)
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14451 - DNA, 31 bp, Artificial Sequence; identical to SEQ ID NO: 14423
  Pan degenerate oligonucleotide primer
  primer_bind (1)..(31)
  misc_feature (25)..(31): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14452 - DNA, 30 bp, Artificial Sequence; identical to SEQ ID NO: 14426
  Pan degenerate oligonucleotide primer
  primer_bind (1)..(30)
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14453 - DNA, 40 bp, Artificial Sequence; identical to SEQ ID NO: 14429
  Pan degenerate oligonucleotide primer
  primer_bind (1)..(40)
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14454 - DNA, 35 bp, Artificial Sequence; identical to SEQ ID NO: 14432
  Pan degenerate oligonucleotide primer
  primer_bind (1)..(35)
  misc_feature (29)..(35): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14455 - DNA, 33 bp, Artificial Sequence; identical to SEQ ID NO: 14435
  Pan degenerate oligonucleotide primer
  primer_bind (1)..(33)
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14456 - DNA, 32 bp, Artificial Sequence; identical to SEQ ID NO: 14438
  Pan degenerate oligonucleotide primer
  primer_bind (1)..(32)
  misc_feature (26)..(32): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14457 - DNA, 30 bp, Artificial Sequence; identical to SEQ ID NO: 14441
  Pan degenerate oligonucleotide primer
  primer_bind (1)..(30)
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.

SEQ ID NO: 14458 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 140 to correspond to the nucleotides in an oligonucleotide probe upstream of the discriminating single nucleotide polymorphism.
gytggtgggcvrrbrtcmmrcargaattt

SEQ ID NO: 14459 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 140 to correspond to the nucleotides in an oligonucleotide probe upstream of the discriminating single nucleotide polymorphism.
rcrgthaargchgcmtgytggtgggcvrrdrtymvrcargaattt

SEQ ID NO: 14460 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aargchgcmtgytggtgggcvrrbrtcmmrcargaatttgn

SEQ ID NO: 14461 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 140 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
chgcmtgytggtgggcvrrbrtcmmrcargaatttgn

SEQ ID NO: 14462 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 140 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
gcmtgytggtgggcvrrbrtcmmrcargaatttgn

SEQ ID NO: 14463 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cmtgytggtgggcvrrbrtcmmrcargaatttgn

SEQ ID NO: 14464 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 140 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
tgytggtgggcvrrbrtcmmrcargaatttgn

SEQ ID NO: 14465 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
gytggtgggcvrrbrtcmmrcargaatttgn

SEQ ID NO: 14466 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 140 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
haargchgcmtgytggtgggcvrrbrtcmmrcargaatttn

SEQ ID NO: 14467 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 140 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
chgcmtgytggtgggcvrrbrtcmmrcargaatttn

SEQ ID NO: 14468 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 140 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
gcmtgytggtgggcvrrbrtcmmrcargaatttn

SEQ ID NO: 14469 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 140 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
cmtgytggtgggcvrrbrtcmmrcargaatttn

SEQ ID NO: 14470 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 140 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
tgytggtgggcvrrbrtcmmrcargaatttn

SEQ ID NO: 14471 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 140 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
gytggtgggcvrrbrtcmmrcargaatttn

SEQ ID NO: 14472 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 140 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
rcrgthaargchgcmtgytggtgggcvrrdrtymvrcargaatttn

SEQ ID NO: 14473 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.
tgytggtgggcvrrbrtcmmrcargaatttggvatyccct

SEQ ID NO: 14474 - DNA, 40 bp, Artificial Sequence; identical to SEQ ID NO: 14473
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14475 - DNA, 40 bp, Artificial Sequence; identical to SEQ ID NO: 14473
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14476 - DNA, 39 bp, Artificial Sequence
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 143 to correspond to the nucleotides in an oligonucleotide probe upstream of the discriminating single nucleotide polymorphism.
gytggtgggcvrrbrtcmmrcargaatttggvatyccct

SEQ ID NO: 14477 - DNA, 39 bp, Artificial Sequence; identical to SEQ ID NO: 14476
  Pan degenerate oligonucleotide primer
  primer_bind (1)..(39)
  modified_base (1)..(1): base is a locked nucleic acid
  modified_base (4)..(4): base is a locked nucleic acid
  modified_base (5)..(5): base is a locked nucleic acid
  misc_feature (33)..(39): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14478 - DNA, 39 bp, Artificial Sequence; identical to SEQ ID NO: 14476
  Pan degenerate oligonucleotide primer
  primer_bind (1)..(39)
  modified_base (1)..(1): base is a locked nucleic acid
  modified_base (3)..(3): base is a locked nucleic acid
  modified_base (5)..(5): base is a locked nucleic acid
  misc_feature (33)..(39): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14479 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (3)..(3): base is a locked nucleic acid
  misc_feature (31)..(37): Adaptor region of the pan degenerate sense primer that adapts the probe-binding site upstream of codon 143 to correspond to the nucleotides in an oligonucleotide probe upstream of the discriminating single nucleotide polymorphism.
tggtgggcvrrbrtcmmrcargaatttggvatyccct

SEQ ID NO: 14480 - DNA, 37 bp, Artificial Sequence; identical to SEQ ID NO: 14479
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14481 - DNA, 37 bp, Artificial Sequence; identical to SEQ ID NO: 14479
  Pan degenerate oligonucleotide primer
  primer_bind (1)..(37)
  modified_base (1)..(1): base is a locked nucleic acid
  modified_base (2)..(2): base is a locked nucleic acid
  modified_base (6)..(6): base is a locked nucleic acid
  misc_feature (31)..(37): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14482 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.
ggtgggcvrrbrtcmmrcargaatttggvatyccct

SEQ ID NO: 14483 - DNA, 36 bp, Artificial Sequence; identical to SEQ ID NO: 14482
  Pan degenerate oligonucleotide primer
  primer_bind (1)..(36)
  modified_base (1)..(1): base is a locked nucleic acid
  modified_base (5)..(5): base is a locked nucleic acid
  modified_base (6)..(6): base is a locked nucleic acid
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14484 - DNA, 36 bp, Artificial Sequence; identical to SEQ ID NO: 14482
  Pan degenerate oligonucleotide primer
  primer_bind (1)..(36)
  modified_base (1)..(1): base is a locked nucleic acid
  modified_base (2)..(2): base is a locked nucleic acid
  modified_base (6)..(6): base is a locked nucleic acid
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14485 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.
gtgggcvrrbrtcmmrcargaatttggvatyccct

SEQ ID NO: 14486 - DNA, 35 bp, Artificial Sequence; identical to SEQ ID NO: 14485
  Pan degenerate oligonucleotide primer
  primer_bind (1)..(35)
  modified_base (1)..(1): base is a locked nucleic acid
  modified_base (5)..(5): base is a locked nucleic acid
  modified_base (6)..(6): base is a locked nucleic acid
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14487 - DNA, 35 bp, Artificial Sequence; identical to SEQ ID NO: 14485
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14488 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (3)..(3): base is a locked nucleic acid
  misc_feature (26)..(32): Adaptor region of the pan degenerate sense primer that adapts the probe-binding site upstream of codon 143 to correspond to the nucleotides in an oligonucleotide probe upstream of the discriminating single nucleotide polymorphism.
ggcvrrbrtcmmrcargaatttggvatyccct

SEQ ID NO: 14489 - DNA, 32 bp, Artificial Sequence; identical to SEQ ID NO: 14488
  Pan degenerate oligonucleotide primer
  primer_bind (1)..(32)
  modified_base (1)..(1): base is a locked nucleic acid
  modified_base (3)..(3): base is a locked nucleic acid
  modified_base (9)..(9): base is a locked nucleic acid
  misc_feature (26)..(32): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14490 - DNA, 32 bp, Artificial Sequence; identical to SEQ ID NO: 14488
  Pan degenerate oligonucleotide primer
  primer_bind (1)..(32)
  modified_base (1)..(1): base is a locked nucleic acid
  modified_base (2)..(2): base is a locked nucleic acid
  modified_base (9)..(9): base is a locked nucleic acid
  misc_feature (26)..(32): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14491 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.
mtgytggtgggcvrrbrtcmmrcargaatttggvatyccc

SEQ ID NO: 14492 - DNA, 40 bp, Artificial Sequence; identical to SEQ ID NO: 14491
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14493 - DNA, 40 bp, Artificial Sequence; identical to SEQ ID NO: 14491
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14494 - DNA, 38 bp, Artificial Sequence
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 143 to correspond to the nucleotides in an oligonucleotide probe upstream of the discriminating single nucleotide polymorphism.
gytggtgggcvrrbrtcmmrcargaatttggvatyccc

SEQ ID NO: 14495 - DNA, 38 bp, Artificial Sequence; identical to SEQ ID NO: 14494
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14496 - DNA, 38 bp, Artificial Sequence; identical to SEQ ID NO: 14494
  Pan degenerate oligonucleotide primer
  primer_bind (1)..(38)
  modified_base (1)..(1): base is a locked nucleic acid
  modified_base (3)..(3): base is a locked nucleic acid
  modified_base (5)..(5): base is a locked nucleic acid
  misc_feature (32)..(38): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14497 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (3)..(3): base is a locked nucleic acid
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.
tggtgggcvrrbrtcmmrcargaatttggvatyccc

SEQ ID NO: 14498 - DNA, 36 bp, Artificial Sequence; identical to SEQ ID NO: 14497
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14499 - DNA, 36 bp, Artificial Sequence; identical to SEQ ID NO: 14497
  Pan degenerate oligonucleotide primer
  primer_bind (1)..(36)
  modified_base (1)..(1): base is a locked nucleic acid
  modified_base (2)..(2): base is a locked nucleic acid
  modified_base (6)..(6): base is a locked nucleic acid
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14500 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.
ggtgggcvrrbrtcmmrcargaatttggvatyccc

SEQ ID NO: 14501 - DNA, 35 bp, Artificial Sequence; identical to SEQ ID NO: 14500
  Pan degenerate oligonucleotide primer
  primer_bind (1)..(35)
  modified_base (1)..(1): base is a locked nucleic acid
  modified_base (5)..(5): base is a locked nucleic acid
  modified_base (6)..(6): base is a locked nucleic acid
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14502 - DNA, 35 bp, Artificial Sequence; identical to SEQ ID NO: 14500
  Pan degenerate oligonucleotide primer
  primer_bind (1)..(35)
  modified_base (1)..(1): base is a locked nucleic acid
  modified_base (2)..(2): base is a locked nucleic acid
  modified_base (6)..(6): base is a locked nucleic acid
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14503 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 143 to correspond to the nucleotides in an oligonucleotide probe upstream of the discriminating single nucleotide polymorphism.
gtgggcvrrbrtcmmrcargaatttggvatyccc

SEQ ID NO: 14504 - DNA, 34 bp, Artificial Sequence; identical to SEQ ID NO: 14503
  Pan degenerate oligonucleotide primer
  primer_bind (1)..(34)
  modified_base (1)..(1): base is a locked nucleic acid
  modified_base (5)..(5): base is a locked nucleic acid
  modified_base (6)..(6): base is a locked nucleic acid
  misc_feature (28)..(34): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14505 - DNA, 34 bp, Artificial Sequence; identical to SEQ ID NO: 14503
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14506 - DNA, 31 bp, Artificial Sequence
  Pan degenerate oligonucleotide primer
  primer_bind (1)..(31)
  modified_base (1)..(1): base is a locked nucleic acid
  modified_base (2)..(2): base is a locked nucleic acid
  modified_base (3)..(3): base is a locked nucleic acid
  misc_feature (25)..(31): Adaptor region of the pan degenerate sense primer that adapts the probe-binding site upstream of codon 143 to correspond to the nucleotides in an oligonucleotide probe upstream of the discriminating single nucleotide polymorphism.
ggcvrrbrtcmmrcargaatttggvatyccc

SEQ ID NO: 14507 - DNA, 31 bp, Artificial Sequence; identical to SEQ ID NO: 14506
  Pan degenerate oligonucleotide primer
  primer_bind (1)..(31)
  modified_base (1)..(1): base is a locked nucleic acid
  modified_base (3)..(3): base is a locked nucleic acid
  modified_base (9)..(9): base is a locked nucleic acid
  misc_feature (25)..(31): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14508 - DNA, 31 bp, Artificial Sequence; identical to SEQ ID NO: 14506
  Pan degenerate oligonucleotide primer
  primer_bind (1)..(31)
  modified_base (1)..(1): base is a locked nucleic acid
  modified_base (2)..(2): base is a locked nucleic acid
  modified_base (9)..(9): base is a locked nucleic acid
  misc_feature (25)..(31): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14509 - DNA, 40 bp, Artificial Sequence; identical to SEQ ID NO: 14473
  Pan degenerate oligonucleotide primer
  primer_bind (1)..(40)
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14510 - DNA, 39 bp, Artificial Sequence; identical to SEQ ID NO: 14476
  Pan degenerate oligonucleotide primer
  primer_bind (1)..(39)
  misc_feature (33)..(39): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14511 - DNA, 37 bp, Artificial Sequence; identical to SEQ ID NO: 14479
  Pan degenerate oligonucleotide primer
  primer_bind (1)..(37)
  misc_feature (31)..(37): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14512 - DNA, 36 bp, Artificial Sequence; identical to SEQ ID NO: 14482
  Pan degenerate oligonucleotide primer
  primer_bind (1)..(36)
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14513 - DNA, 35 bp, Artificial Sequence; identical to SEQ ID NO: 14485
  Pan degenerate oligonucleotide primer
  primer_bind (1)..(35)
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14514 - DNA, 32 bp, Artificial Sequence; identical to SEQ ID NO: 14488
  Pan degenerate oligonucleotide primer
  primer_bind (1)..(32)
  misc_feature (26)..(32): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14515 - DNA, 40 bp, Artificial Sequence; identical to SEQ ID NO: 14491
  Pan degenerate oligonucleotide primer
  primer_bind (1)..(40)
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14516 - DNA, 38 bp, Artificial Sequence; identical to SEQ ID NO: 14494
  Pan degenerate oligonucleotide primer
  primer_bind (1)..(38)
  misc_feature (32)..(38): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14517 - DNA, 36 bp, Artificial Sequence; identical to SEQ ID NO: 14497
  Pan degenerate oligonucleotide primer
  primer_bind (1)..(36)
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14518 - DNA, 35 bp, Artificial Sequence; identical to SEQ ID NO: 14500
  Pan degenerate oligonucleotide primer
  primer_bind (1)..(35)
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14519 - DNA, 34 bp, Artificial Sequence; identical to SEQ ID NO: 14503
  Pan degenerate oligonucleotide primer
  primer_bind (1)..(34)
  misc_feature (28)..(34): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14520 - DNA, 31 bp, Artificial Sequence; identical to SEQ ID NO: 14506
  Pan degenerate oligonucleotide primer
  primer_bind (1)..(31)
  misc_feature (25)..(31): Adaptor region of the pan degenerate sense primer that adapts the probe-binding site upstream of codon 143 to correspond to the nucleotides in an oligonucleotide probe upstream of the discriminating single nucleotide polymorphism.

SEQ ID NO: 14521 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 143 to correspond to the nucleotides in an oligonucleotide probe upstream of the discriminating single nucleotide polymorphism.
gchgcmtgytggtgggcvrrdrtymvrcargartttggvattccc

SEQ ID NO: 14522 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
tgytggtgggcvrrbrtcmmrcargaatttggvatyccctn

SEQ ID NO: 14523 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 143 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
gytggtgggcvrrbrtcmmrcargaatttggvatyccctn

SEQ ID NO: 14524 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 143 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
tggtgggcvrrbrtcmmrcargaatttggvatyccctn

SEQ ID NO: 14525 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ggtgggcvrrbrtcmmrcargaatttggvatyccctn

SEQ ID NO: 14526 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
gtgggcvrrbrtcmmrcargaatttggvatyccctn

SEQ ID NO: 14527 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 143 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
ggcvrrbrtcmmrcargaatttggvatyccctn

SEQ ID NO: 14528 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 143 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
mtgytggtgggcvrrbrtcmmrcargaatttggvatycccn

SEQ ID NO: 14529 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 143 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
gytggtgggcvrrbrtcmmrcargaatttggvatycccn

SEQ ID NO: 14530 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 143 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
tggtgggcvrrbrtcmmrcargaatttggvatycccn

SEQ ID NO: 14531 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 143 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
ggtgggcvrrbrtcmmrcargaatttggvatycccn

SEQ ID NO: 14532 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 143 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
gtgggcvrrbrtcmmrcargaatttggvatycccn

SEQ ID NO: 14533 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 143 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
ggcvrrbrtcmmrcargaatttggvatycccn

SEQ ID NO: 14534 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 143 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gchgcmtgytggtgggcvrrdrtymvrcargartttggvattcccn

SEQ ID NO: 14535 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 145 to correspond to the nucleotides in an oligonucleotide probe upstream of the discriminating single nucleotide polymorphism.
gtgggcvrrbrtcmmrcargaatttggvatyccctacaat

SEQ ID NO: 14536 - DNA, 40 bp, Artificial Sequence; identical to SEQ ID NO: 14535
  Pan degenerate oligonucleotide primer
  primer_bind (1)..(40)
  modified_base (1)..(1): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14537 - DNA, 40 bp, Artificial Sequence; identical to SEQ ID NO: 14535
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14538 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (3)..(3): base is a locked nucleic acid
  misc_feature (31)..(37): Adaptor region of the pan degenerate sense primer that adapts the probe-binding site upstream of codon 145 to correspond to the nucleotides in an oligonucleotide probe upstream of the discriminating single nucleotide polymorphism.
ggcvrrbrtcmmrcargaatttggvatyccctacaat

SEQ ID NO: 14539 - DNA, 37 bp, Artificial Sequence; identical to SEQ ID NO: 14538
  Pan degenerate oligonucleotide primer
  primer_bind (1)..(37)
  modified_base (1)..(1): base is a locked nucleic acid
  modified_base (3)..(3): base is a locked nucleic acid
  modified_base (9)..(9): base is a locked nucleic acid
  misc_feature (31)..(37): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14540 - DNA, 37 bp, Artificial Sequence; identical to SEQ ID NO: 14538
  Pan degenerate oligonucleotide primer
  primer_bind (1)..(37)
  modified_base (1)..(1): base is a locked nucleic acid
  modified_base (2)..(2): base is a locked nucleic acid
  modified_base (9)..(9): base is a locked nucleic acid
  misc_feature (31)..(37): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14541 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (8)..(8): base is a locked nucleic acid
  misc_feature (30)..(36): Adaptor region of the pan degenerate sense primer that adapts the probe-binding site upstream of codon 145 to correspond to the nucleotides in an oligonucleotide probe upstream of the discriminating single nucleotide polymorphism.
gcvrrbrtcmmrcargaatttggvatyccctacaat

SEQ ID NO: 14542 - DNA, 36 bp, Artificial Sequence; identical to SEQ ID NO: 14541
  Pan degenerate oligonucleotide primer
  primer_bind (1)..(36)
  modified_base (1)..(1): base is a locked nucleic acid
  modified_base (8)..(8): base is a locked nucleic acid
  modified_base (13)..(13): base is a locked nucleic acid
  misc_feature (30)..(36): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14543 - DNA, 36 bp, Artificial Sequence; identical to SEQ ID NO: 14541
  Pan degenerate oligonucleotide primer
  primer_bind (1)..(36)
  modified_base (1)..(1): base is a locked nucleic acid
  modified_base (2)..(2): base is a locked nucleic acid
  modified_base (13)..(13): base is a locked nucleic acid
  misc_feature (30)..(36): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14544 - DNA, 35 bp, Artificial Sequence
  Pan degenerate oligonucleotide primer
  primer_bind (1)..(35)
  modified_base (1)..(1): base is a locked nucleic acid
  modified_base (7)..(7): base is a locked nucleic acid
  modified_base (12)..(12): base is a locked nucleic acid
  misc_feature (29)..(35): Adaptor region of the pan degenerate sense primer that adapts the probe-binding site upstream of codon 145 to correspond to the nucleotides in an oligonucleotide probe upstream of the discriminating single nucleotide polymorphism.
cvrrbrtcmmrcargaatttggvatyccctacaat

SEQ ID NO: 14545 - DNA, 35 bp, Artificial Sequence; identical to SEQ ID NO: 14544
  Pan degenerate oligonucleotide primer
  primer_bind (1)..(35)
  modified_base (1)..(1): base is a locked nucleic acid
  modified_base (12)..(12): base is a locked nucleic acid
  modified_base (13)..(13): base is a locked nucleic acid
  misc_feature (29)..(35): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14546 - DNA, 35 bp, Artificial Sequence; identical to SEQ ID NO: 14544
  Pan degenerate oligonucleotide primer
  primer_bind (1)..(35)
  modified_base (1)..(1): base is a locked nucleic acid
  modified_base (7)..(7): base is a locked nucleic acid
  modified_base (13)..(13): base is a locked nucleic acid
  misc_feature (29)..(35): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14547 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate sense primer that adapts the probe-binding site upstream of codon 145 to correspond to the nucleotides in an oligonucleotide probe upstream of the discriminating single nucleotide polymorphism.
tcmmrcargaatttggvatyccctacaat

SEQ ID NO: 14548 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (9)..(9): base is a locked nucleic acid
  misc_feature (23)..(29): Adaptor region of the pan degenerate sense primer that adapts the probe-binding site upstream of codon 145 to correspond to the nucleotides in an oligonucleotide probe upstream of the discriminating single nucleotide polymorphism.
tcmmrcargaatttggvatyccctacaat

SEQ ID NO: 14549 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (9)..(9): base is a locked nucleic acid
  misc_feature (23)..(29): Adaptor region of the pan degenerate sense primer that adapts the probe-binding site upstream of codon 145 to correspond to the nucleotides in an oligonucleotide probe upstream of the discriminating single nucleotide polymorphism.
tcmmrcargaatttggvatyccctacaat

SEQ ID NO: 14550 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate sense primer that adapts the probe-binding site upstream of codon 145 to correspond to the nucleotides in an oligonucleotide probe upstream of the discriminating single nucleotide polymorphism.
cargaatttggvatyccctacaat

SEQ ID NO: 14551 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate sense primer that adapts the probe-binding site upstream of codon 145 to correspond to the nucleotides in an oligonucleotide probe upstream of the discriminating single nucleotide polymorphism.
cargaatttggvatyccctacaat

SEQ ID NO: 14552 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (7)..(7): base is a locked nucleic acid
  misc_feature (18)..(24): Adaptor region of the pan degenerate sense primer that adapts the probe-binding site upstream of codon 145 to correspond to the nucleotides in an oligonucleotide probe upstream of the discriminating single nucleotide polymorphism.
cargaatttggvatyccctacaat

SEQ ID NO: 14553 - DNA, 40 bp, Artificial Sequence; identical to SEQ ID NO: 14535
  Pan degenerate oligonucleotide primer
  primer_bind (1)..(40)
  misc_feature (34)..(40): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14554 - DNA, 37 bp, Artificial Sequence; identical to SEQ ID NO: 14538
  Pan degenerate oligonucleotide primer
  primer_bind (1)..(37)
  misc_feature (31)..(37): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14555 - DNA, 36 bp, Artificial Sequence; identical to SEQ ID NO: 14541
  Pan degenerate oligonucleotide primer
  primer_bind (1)..(36)
  misc_feature (30)..(36): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14556 - DNA, 35 bp, Artificial Sequence; identical to SEQ ID NO: 14544
  Pan degenerate oligonucleotide primer
  primer_bind (1)..(35)
  misc_feature (29)..(35): Adaptor region of the pan degenerate sense primer that adapts the probe-binding site upstream of codon 145 to correspond to the nucleotides in an oligonucleotide probe upstream of the discriminating single nucleotide polymorphism.

SEQ ID NO: 14557 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 145 to correspond to the nucleotides in an oligonucleotide probe upstream of the discriminating single nucleotide polymorphism.
tcmmrcargaatttggvatyccctacaat

SEQ ID NO: 14558 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 145 to correspond to the nucleotides in an oligonucleotide probe upstream of the discriminating single nucleotide polymorphism.
cargaatttggvatyccctacaat

SEQ ID NO: 14559 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 145 to correspond to the nucleotides in an oligonucleotide probe upstream of the discriminating single nucleotide polymorphism.
tgytggtgggcvrrdrtymvrcargartttggvatyccctacaat

SEQ ID NO: 14560 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 145 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gtgggcvrrbrtcmmrcargaatttggvatyccctacaatn

SEQ ID NO: 14561 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 145 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ggcvrrbrtcmmrcargaatttggvatyccctacaatn

SEQ ID NO: 14562 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 145 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
gcvrrbrtcmmrcargaatttggvatyccctacaatn

SEQ ID NO: 14563 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 145 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
cvrrbrtcmmrcargaatttggvatyccctacaatn

SEQ ID NO: 14564 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 145 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
tcmmrcargaatttggvatyccctacaatn

SEQ ID NO: 14565 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 145 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
cargaatttggvatyccctacaatn

SEQ ID NO: 14566 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 145 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
tgytggtgggcvrrdrtymvrcargartttggvatyccctacaatn

SEQ ID NO: 14567 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (8)..(8): base is a locked nucleic acid
  misc_feature (34)..(40): Adaptor region of the pan degenerate sense primer that adapts the probe-binding site upstream of codon 146 to correspond to the nucleotides in an oligonucleotide probe upstream of the discriminating single nucleotide polymorphism.
gcvrrbrtcmmrcargaatttggvatyccctacaatcccc

SEQ ID NO: 14568 - DNA, 40 bp, Artificial Sequence; identical to SEQ ID NO: 14567
  Pan degenerate oligonucleotide primer
  primer_bind (1)..(40)
  modified_base (1)..(1): base is a locked nucleic acid
  modified_base (8)..(8): base is a locked nucleic acid
  modified_base (13)..(13): base is a locked nucleic acid
  misc_feature (34)..(40): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14569 - DNA, 40 bp, Artificial Sequence; identical to SEQ ID NO: 14567
  Pan degenerate oligonucleotide primer
  primer_bind (1)..(40)
  modified_base (1)..(1): base is a locked nucleic acid
  modified_base (2)..(2): base is a locked nucleic acid
  modified_base (13)..(13): base is a locked nucleic acid
  misc_feature (34)..(40): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14570 - DNA, 39 bp, Artificial Sequence
  Pan degenerate oligonucleotide primer
  primer_bind (1)..(39)
  modified_base (1)..(1): base is a locked nucleic acid
  modified_base (7)..(7): base is a locked nucleic acid
  modified_base (12)..(12): base is a locked nucleic acid
  misc_feature (33)..(39): Adaptor region of the pan degenerate sense primer that adapts the probe-binding site upstream of codon 146 to correspond to the nucleotides in an oligonucleotide probe upstream of the discriminating single nucleotide polymorphism.
cvrrbrtcmmrcargaatttggvatyccctacaatcccc

SEQ ID NO: 14571 - DNA, 39 bp, Artificial Sequence; identical to SEQ ID NO: 14570
  Pan degenerate oligonucleotide primer
  primer_bind (1)..(39)
  modified_base (1)..(1): base is a locked nucleic acid
  modified_base (12)..(12): base is a locked nucleic acid
  modified_base (13)..(13): base is a locked nucleic acid
  misc_feature (33)..(39): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14572 - DNA, 39 bp, Artificial Sequence; identical to SEQ ID NO: 14570
  Pan degenerate oligonucleotide primer
  primer_bind (1)..(39)
  modified_base (1)..(1): base is a locked nucleic acid
  modified_base (7)..(7): base is a locked nucleic acid
  modified_base (13)..(13): base is a locked nucleic acid
  misc_feature (33)..(39): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14573 - DNA, 33 bp, Artificial Sequence
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (27)..(33): Adaptor region of the pan degenerate sense primer that adapts the probe-binding site upstream of codon 146 to correspond to the nucleotides in an oligonucleotide probe upstream of the discriminating single nucleotide polymorphism.
tcmmrcargaatttggvatyccctacaatcccc

SEQ ID NO: 14574 - DNA, 33 bp, Artificial Sequence; identical to SEQ ID NO: 14573
  Pan degenerate oligonucleotide primer
  primer_bind (1)..(33)
  modified_base (1)..(1): base is a locked nucleic acid
  modified_base (7)..(7): base is a locked nucleic acid
  modified_base (9)..(9): base is a locked nucleic acid
  misc_feature (27)..(33): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14575 - DNA, 33 bp, Artificial Sequence; identical to SEQ ID NO: 14573
  Pan degenerate oligonucleotide primer
  primer_bind (1)..(33)
  modified_base (1)..(1): base is a locked nucleic acid
  modified_base (6)..(6): base is a locked nucleic acid
  modified_base (9)..(9): base is a locked nucleic acid
  misc_feature (27)..(33): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14576 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (4)..(4): base is a locked nucleic acid
  misc_feature (22)..(28): Adaptor region of the pan degenerate sense primer that adapts the probe-binding site upstream of codon 146 to correspond to the nucleotides in an oligonucleotide probe upstream of the discriminating single nucleotide polymorphism.
cargaatttggvatyccctacaatcccc

SEQ ID NO: 14577 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate sense primer that adapts the probe-binding site upstream of codon 146 to correspond to the nucleotides in an oligonucleotide probe upstream of the discriminating single nucleotide polymorphism.
cargaatttggvatyccctacaatcccc

SEQ ID NO: 14578 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (7)..(7): base is a locked nucleic acid
  misc_feature (22)..(28): Adaptor region of the pan degenerate sense primer that adapts the probe-binding site upstream of codon 146 to correspond to the nucleotides in an oligonucleotide probe upstream of the discriminating single nucleotide polymorphism.
cargaatttggvatyccctacaatcccc

SEQ ID NO: 14579 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (6)..(6): base is a locked nucleic acid
  misc_feature (21)..(27): Adaptor region of the pan degenerate sense primer that adapts the probe-binding site upstream of codon 146 to correspond to the nucleotides in an oligonucleotide probe upstream of the discriminating single nucleotide polymorphism.
argaatttggvatyccctacaatcccc

SEQ ID NO: 14580 - DNA, 27 bp, Artificial Sequence
  Pan degenerate oligonucleotide primer
  primer_bind (1)..(27)
  modified_base (1)..(1): base is a locked nucleic acid
  modified_base (6)..(6): base is a locked nucleic acid
  modified_base (10)..(10): base is a locked nucleic acid
  misc_feature (21)..(27): Adaptor region of the pan degenerate sense primer that adapts the probe-binding site upstream of codon 146 to correspond to the nucleotides in an oligonucleotide probe upstream of the discriminating single nucleotide polymorphism.
argaatttggvatyccctacaatcccc

SEQ ID NO: 14581 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (10)..(10): base is a locked nucleic acid
  misc_feature (21)..(27): Adaptor region of the pan degenerate sense primer that adapts the probe-binding site upstream of codon 146 to correspond to the nucleotides in an oligonucleotide probe upstream of the discriminating single nucleotide polymorphism.
argaatttggvatyccctacaatcccc

SEQ ID NO: 14582 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (8)..(8): base is a locked nucleic acid
  misc_feature (19)..(25): Adaptor region of the pan degenerate sense primer that adapts the probe-binding site upstream of codon 146 to correspond to the nucleotides in an oligonucleotide probe upstream of the discriminating single nucleotide polymorphism.
gaatttggvatyccctacaatcccc

SEQ ID NO: 14583 - DNA, 25 bp, Artificial Sequence
  Pan degenerate oligonucleotide primer
  primer_bind (1)..(25)
  modified_base (1)..(1): base is a locked nucleic acid
  modified_base (8)..(8): base is a locked nucleic acid
  modified_base (11)..(11): base is a locked nucleic acid
  misc_feature (19)..(25): Adaptor region of the pan degenerate sense primer that adapts the probe-binding site upstream of codon 146 to correspond to the nucleotides in an oligonucleotide probe upstream of the discriminating single nucleotide polymorphism.
gaatttggvatyccctacaatcccc

SEQ ID NO: 14584 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (11)..(11): base is a locked nucleic acid
  misc_feature (19)..(25): Adaptor region of the pan degenerate sense primer that adapts the probe-binding site upstream of codon 146 to correspond to the nucleotides in an oligonucleotide probe upstream of the discriminating single nucleotide polymorphism.
gaatttggvatyccctacaatcccc

SEQ ID NO: 14585 - DNA, 40 bp, Artificial Sequence; identical to SEQ ID NO: 14567
  Pan degenerate oligonucleotide primer
  primer_bind (1)..(40)
  misc_feature (34)..(40): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14586 - DNA, 39 bp, Artificial Sequence; identical to SEQ ID NO: 14570
  Pan degenerate oligonucleotide primer
  primer_bind (1)..(39)
  misc_feature (33)..(39): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14587 - DNA, 33 bp, Artificial Sequence; identical to SEQ ID NO: 14573
  Pan degenerate oligonucleotide primer
  primer_bind (1)..(33)
  misc_feature (27)..(33): Adaptor region of the pan degenerate sense primer that adapts the probe-binding site upstream of codon 146 to correspond to the nucleotides in an oligonucleotide probe upstream of the discriminating single nucleotide polymorphism.

SEQ ID NO: 14588 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 146 to correspond to the nucleotides in an oligonucleotide probe upstream of the discriminating single nucleotide polymorphism.
cargaatttggvatyccctacaatcccc

SEQ ID NO: 14589 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 146 to correspond to the nucleotides in an oligonucleotide probe upstream of the discriminating single nucleotide polymorphism.
argaatttggvatyccctacaatcccc

SEQ ID NO: 14590 - DNA, 25 bp, Artificial Sequence
  Pan degenerate oligonucleotide primer
  primer_bind (1)..(25)
  misc_feature (19)..(25): Adaptor region of the pan degenerate sense primer that adapts the probe-binding site upstream of codon 146 to correspond to the nucleotides in an oligonucleotide probe upstream of the discriminating single nucleotide polymorphism.
gaatttggvatyccctacaatcccc

SEQ ID NO: 14591 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 146 to correspond to the nucleotides in an oligonucleotide probe upstream of the discriminating single nucleotide polymorphism.
tggtgggcvrrdrtymvrcargartttggvatyccctacaatccc

SEQ ID NO: 14592 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 146 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gcvrrbrtcmmrcargaatttggvatyccctacaatccccn

SEQ ID NO: 14593 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 146 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
cvrrbrtcmmrcargaatttggvatyccctacaatccccn

SEQ ID NO: 14594 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 146 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tcmmrcargaatttggvatyccctacaatccccn

SEQ ID NO: 14595 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 146 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
cargaatttggvatyccctacaatccccn

SEQ ID NO: 14596 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 146 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
argaatttggvatyccctacaatccccn

SEQ ID NO: 14597 - DNA, 26 bp, Artificial Sequence
  Pan degenerate oligonucleotide primer
  primer_bind (1)..(26)
  misc_feature (19)..(25): Adaptor region of the pan degenerate sense primer that adapts the probe-binding site upstream of codon 146 to correspond to the nucleotides in an oligonucleotide probe upstream of the discriminating single nucleotide polymorphism.
  modified_base (26)..(26): base is a locked nucleic acid
  misc_feature (26)..(26): n is a, c, g, or t
gaatttggvatyccctacaatccccn

SEQ ID NO: 14598 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 146 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
tggtgggcvrrdrtymvrcargartttggvatyccctacaatcccn

SEQ ID NO: 14599 - DNA, 40 bp, Artificial Sequence
  Pan degenerate oligonucleotide primer
  primer_bind (1)..(40)
  modified_base (6)..(6): base is a locked nucleic acid
  modified_base (11)..(11): base is a locked nucleic acid
  modified_base (12)..(12): base is a locked nucleic acid
  misc_feature (34)..(40): Adaptor region of the pan degenerate sense primer that adapts the probe-binding site upstream of codon 147 to correspond to the nucleotides in an oligonucleotide probe upstream of the discriminating single nucleotide polymorphism.
vrrbrtcmmrcargaatttggvatyccctacaatccccaa

SEQ ID NO: 14600 - DNA, 40 bp, Artificial Sequence; identical to SEQ ID NO: 14599
  Pan degenerate oligonucleotide primer
  primer_bind (1)..(40)
  modified_base (6)..(6): base is a locked nucleic acid
  modified_base (12)..(12): base is a locked nucleic acid
  modified_base (14)..(14): base is a locked nucleic acid
  misc_feature (34)..(40): Adaptor region of the pan degenerate sense primer that adapts the probe-binding site upstream of codon 147 to correspond to the nucleotides in an oligonucleotide probe upstream of the discriminating single nucleotide polymorphism.

SEQ ID NO: 14601 - DNA, 40 bp, Artificial Sequence; identical to SEQ ID NO: 14599
  Pan degenerate oligonucleotide primer
  primer_bind (1)..(40)
  modified_base (6)..(6): base is a locked nucleic acid
  modified_base (11)..(11): base is a locked nucleic acid
  modified_base (14)..(14): base is a locked nucleic acid
  misc_feature (34)..(40): Adaptor region of the pan degenerate sense primer that adapts the probe-binding site upstream of codon 147 to correspond to the nucleotides in an oligonucleotide probe upstream of the discriminating single nucleotide polymorphism.

SEQ ID NO: 14602 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 147 to correspond to the nucleotides in an oligonucleotide probe upstream of the discriminating single nucleotide polymorphism.
cargaatttggvatyccctacaatccccaa

SEQ ID NO: 14603 - DNA, 30 bp, Artificial Sequence; identical to SEQ ID NO: 14602
  Pan degenerate oligonucleotide primer
  primer_bind (1)..(30)
  modified_base (1)..(1): base is a locked nucleic acid
  modified_base (4)..(4): base is a locked nucleic acid
  modified_base (7)..(7): base is a locked nucleic acid
  misc_feature (24)..(30): Adaptor region of the pan degenerate sense primer that adapts the probe-binding site upstream of codon 147 to correspond to the nucleotides in an oligonucleotide probe upstream of the discriminating single nucleotide polymorphism.

SEQ ID NO: 14604 - DNA, 30 bp, Artificial Sequence; identical to SEQ ID NO: 14602
  Pan degenerate oligonucleotide primer
  primer_bind (1)..(30)
  modified_base (1)..(1): base is a locked nucleic acid
  modified_base (2)..(2): base is a locked nucleic acid
  modified_base (7)..(7): base is a locked nucleic acid
  misc_feature (24)..(30): Adaptor region of the pan degenerate sense primer that adapts the probe-binding site upstream of codon 147 to correspond to the nucleotides in an oligonucleotide probe upstream of the discriminating single nucleotide polymorphism.

SEQ ID NO: 14605 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate sense primer that adapts the probe-binding site upstream of codon 147 to correspond to the nucleotides in an oligonucleotide probe upstream of the discriminating single nucleotide polymorphism.
argaatttggvatyccctacaatccccaa

SEQ ID NO: 14606 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (10)..(10): base is a locked nucleic acid
  misc_feature (23)..(29): Adaptor region of the pan degenerate sense primer that adapts the probe-binding site upstream of codon 147 to correspond to the nucleotides in an oligonucleotide probe upstream of the discriminating single nucleotide polymorphism.
argaatttggvatyccctacaatccccaa

SEQ ID NO: 14607 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (10)..(10): base is a locked nucleic acid
  misc_feature (23)..(29): Adaptor region of the pan degenerate sense primer that adapts the probe-binding site upstream of codon 147 to correspond to the nucleotides in an oligonucleotide probe upstream of the discriminating single nucleotide polymorphism.
argaatttggvatyccctacaatccccaa

SEQ ID NO: 14608 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (8)..(8): base is a locked nucleic acid
  misc_feature (21)..(27): Adaptor region of the pan degenerate sense primer that adapts the probe-binding site upstream of codon 147 to correspond to the nucleotides in an oligonucleotide probe upstream of the discriminating single nucleotide polymorphism.
gaatttggvatyccctacaatccccaa

SEQ ID NO: 14609 - DNA, 27 bp, Artificial Sequence
  Pan degenerate oligonucleotide primer
  primer_bind (1)..(27)
  modified_base (1)..(1): base is a locked nucleic acid
  modified_base (8)..(8): base is a locked nucleic acid
  modified_base (11)..(11): base is a locked nucleic acid
  misc_feature (21)..(27): Adaptor region of the pan degenerate sense primer that adapts the probe-binding site upstream of codon 147 to correspond to the nucleotides in an oligonucleotide probe upstream of the discriminating single nucleotide polymorphism.
gaatttggvatyccctacaatccccaa

SEQ ID NO: 14610 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (11)..(11): base is a locked nucleic acid
  misc_feature (21)..(27): Adaptor region of the pan degenerate sense primer that adapts the probe-binding site upstream of codon 147 to correspond to the nucleotides in an oligonucleotide probe upstream of the discriminating single nucleotide polymorphism.
gaatttggvatyccctacaatccccaa

SEQ ID NO: 14611 - DNA, 24 bp, Artificial Sequence
  Pan degenerate oligonucleotide primer
  primer_bind (1)..(24)
  modified_base (1)..(1): base is a locked nucleic acid
  modified_base (5)..(5): base is a locked nucleic acid
  modified_base (8)..(8): base is a locked nucleic acid
  misc_feature (18)..(24): Adaptor region of the pan degenerate sense primer that adapts the probe-binding site upstream of codon 147 to correspond to the nucleotides in an oligonucleotide probe upstream of the discriminating single nucleotide polymorphism.
tttggvatyccctacaatccccaa

SEQ ID NO: 14612 - DNA, 24 bp, Artificial Sequence
  Pan degenerate oligonucleotide primer
  primer_bind (1)..(24)
  modified_base (1)..(1): base is a locked nucleic acid
  modified_base (8)..(8): base is a locked nucleic acid
  modified_base (10)..(10): base is a locked nucleic acid
  misc_feature (18)..(24): Adaptor region of the pan degenerate sense primer that adapts the probe-binding site upstream of codon 147 to correspond to the nucleotides in an oligonucleotide probe upstream of the discriminating single nucleotide polymorphism.
tttggvatyccctacaatccccaa

SEQ ID NO: 14613 - DNA, 24 bp, Artificial Sequence
  Pan degenerate oligonucleotide primer
  primer_bind (1)..(24)
  modified_base (1)..(1): base is a locked nucleic acid
  modified_base (5)..(5): base is a locked nucleic acid
  modified_base (10)..(10): base is a locked nucleic acid
  misc_feature (18)..(24): Adaptor region of the pan degenerate sense primer that adapts the probe-binding site upstream of codon 147 to correspond to the nucleotides in an oligonucleotide probe upstream of the discriminating single nucleotide polymorphism.
tttggvatyccctacaatccccaa

SEQ ID NO: 14614 - DNA, 40 bp, Artificial Sequence; identical to SEQ ID NO: 14599
  Pan degenerate oligonucleotide primer
  primer_bind (1)..(40)
  misc_feature (34)..(40): Adaptor region of the pan degenerate sense primer that adapts the probe-binding site upstream of codon 147 to correspond to the nucleotides in an oligonucleotide probe upstream of the discriminating single nucleotide polymorphism.

SEQ ID NO: 14615 - DNA, 30 bp, Artificial Sequence; identical to SEQ ID NO: 14602
  Pan degenerate oligonucleotide primer
  primer_bind (1)..(30)
  misc_feature (24)..(30): Adaptor region of the pan degenerate sense primer that adapts the probe-binding site upstream of codon 147 to correspond to the nucleotides in an oligonucleotide probe upstream of the discriminating single nucleotide polymorphism.

SEQ ID NO: 14616 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 147 to correspond to the nucleotides in an oligonucleotide probe upstream of the discriminating single nucleotide polymorphism.
argaatttggvatyccctacaatccccaa

SEQ ID NO: 14617 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 147 to correspond to the nucleotides in an oligonucleotide probe upstream of the discriminating single nucleotide polymorphism.
gaatttggvatyccctacaatccccaa

SEQ ID NO: 14618 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 147 to correspond to the nucleotides in an oligonucleotide probe upstream of the discriminating single nucleotide polymorphism.
tttggvatyccctacaatccccaa

SEQ ID NO: 14619 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 147 to correspond to the nucleotides in an oligonucleotide probe upstream of the discriminating single nucleotide polymorphism.
tgggcvrrdrtymvrcargartttggvatyccctacaatccccaa

SEQ ID NO: 14620 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 147 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
vrrbrtcmmrcargaatttggvatyccctacaatccccaan

SEQ ID NO: 14621 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 147 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
cargaatttggvatyccctacaatccccaan

SEQ ID NO: 14622 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 147 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
argaatttggvatyccctacaatccccaan

SEQ ID NO: 14623 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 147 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
gaatttggvatyccctacaatccccaan

SEQ ID NO: 14624 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 147 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
tttggvatyccctacaatccccaan

SEQ ID NO: 14625 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 147 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
tgggcvrrdrtymvrcargartttggvatyccctacaatccccaan

SEQ ID NO: 14626 - DNA, 40 bp, Artificial Sequence
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.
tcmmrcargaatttggvatyccctacaatccccaaagyca

SEQ ID NO: 14627 - DNA, 40 bp, Artificial Sequence; identical to SEQ ID NO: 14626
  Pan degenerate oligonucleotide primer
  primer_bind (1)..(40)
  modified_base (1)..(1): base is a locked nucleic acid
  modified_base (7)..(7): base is a locked nucleic acid
  modified_base (9)..(9): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14628 - DNA, 40 bp, Artificial Sequence; identical to SEQ ID NO: 14626
  Pan degenerate oligonucleotide primer
  primer_bind (1)..(40)
  modified_base (1)..(1): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14629 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate sense primer that adapts the probe-binding site upstream of codon 148 to correspond to the nucleotides in an oligonucleotide probe upstream of the discriminating single nucleotide polymorphism.
cargaatttggvatyccctacaatccccaaagyca

SEQ ID NO: 14630 - DNA, 35 bp, Artificial Sequence; identical to SEQ ID NO: 14629
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14631 - DNA, 35 bp, Artificial Sequence; identical to SEQ ID NO: 14629
  Pan degenerate oligonucleotide primer
  primer_bind (1)..(35)
  modified_base (1)..(1): base is a locked nucleic acid
  modified_base (2)..(2): base is a locked nucleic acid
  modified_base (7)..(7): base is a locked nucleic acid
  misc_feature (29)..(35): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14632 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.
argaatttggvatyccctacaatccccaaagyca

SEQ ID NO: 14633 - DNA, 34 bp, Artificial Sequence; identical to SEQ ID NO: 14632
  Pan degenerate oligonucleotide primer
  primer_bind (1)..(34)
  modified_base (1)..(1): base is a locked nucleic acid
  modified_base (6)..(6): base is a locked nucleic acid
  modified_base (10)..(10): base is a locked nucleic acid
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14634 - DNA, 34 bp, Artificial Sequence; identical to SEQ ID NO: 14632
  Pan degenerate oligonucleotide primer
  primer_bind (1)..(34)
  modified_base (1)..(1): base is a locked nucleic acid
  modified_base (3)..(3): base is a locked nucleic acid
  modified_base (10)..(10): base is a locked nucleic acid
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14635 - DNA, 32 bp, Artificial Sequence
  Pan degenerate oligonucleotide primer
  primer_bind (1)..(32)
  modified_base (1)..(1): base is a locked nucleic acid
  modified_base (4)..(4): base is a locked nucleic acid
  modified_base (8)..(8): base is a locked nucleic acid
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.
gaatttggvatyccctacaatccccaaagyca

SEQ ID NO: 14636 - DNA, 32 bp, Artificial Sequence; identical to SEQ ID NO: 14635
  Pan degenerate oligonucleotide primer
  primer_bind (1)..(32)
  modified_base (1)..(1): base is a locked nucleic acid
  modified_base (8)..(8): base is a locked nucleic acid
  modified_base (11)..(11): base is a locked nucleic acid
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14637 - DNA, 32 bp, Artificial Sequence; identical to SEQ ID NO: 14635
  Pan degenerate oligonucleotide primer
  primer_bind (1)..(32)
  modified_base (1)..(1): base is a locked nucleic acid
  modified_base (4)..(4): base is a locked nucleic acid
  modified_base (11)..(11): base is a locked nucleic acid
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14638 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (8)..(8): base is a locked nucleic acid
  misc_feature (23)..(29): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyca

SEQ ID NO: 14639 - DNA, 29 bp, Artificial Sequence
  Pan degenerate oligonucleotide primer
  primer_bind (1)..(29)
  modified_base (1)..(1): base is a locked nucleic acid
  modified_base (8)..(8): base is a locked nucleic acid
  modified_base (10)..(10): base is a locked nucleic acid
  misc_feature (23)..(29): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyca

SEQ ID NO: 14640 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (10)..(10): base is a locked nucleic acid
  misc_feature (23)..(29): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyca

SEQ ID NO: 14641 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (6)..(6): base is a locked nucleic acid
  misc_feature (19)..(25): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyca

SEQ ID NO: 14642 - DNA, 25 bp, Artificial Sequence
  Pan degenerate oligonucleotide primer
  primer_bind (1)..(25)
  modified_base (1)..(1): base is a locked nucleic acid
  modified_base (6)..(6): base is a locked nucleic acid
  modified_base (7)..(7): base is a locked nucleic acid
  misc_feature (19)..(25): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyca

SEQ ID NO: 14643 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (7)..(7): base is a locked nucleic acid
  misc_feature (19)..(25): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyca

SEQ ID NO: 14644 - DNA, 40 bp, Artificial Sequence
  Pan degenerate oligonucleotide primer
  primer_bind (1)..(40)
  modified_base (3)..(3): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.
brtcmmrcargaatttggvatyccctacaatccccaaagy

SEQ ID NO: 14645 - DNA, 40 bp, Artificial Sequence; identical to SEQ ID NO: 14644
  Pan degenerate oligonucleotide primer
  primer_bind (1)..(40)
  modified_base (3)..(3): base is a locked nucleic acid
  modified_base (9)..(9): base is a locked nucleic acid
  modified_base (11)..(11): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14646 - DNA, 40 bp, Artificial Sequence; identical to SEQ ID NO: 14644
  Pan degenerate oligonucleotide primer
  primer_bind (1)..(40)
  modified_base (3)..(3): base is a locked nucleic acid
  modified_base (8)..(8): base is a locked nucleic acid
  modified_base (11)..(11): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14647 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.
cargaatttggvatyccctacaatccccaaagy

SEQ ID NO: 14648 - DNA, 33 bp, Artificial Sequence; identical to SEQ ID NO: 14647
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14649 - DNA, 33 bp, Artificial Sequence; identical to SEQ ID NO: 14647
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14650 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.
argaatttggvatyccctacaatccccaaagy

SEQ ID NO: 14651 - DNA, 32 bp, Artificial Sequence; identical to SEQ ID NO: 14650
  Pan degenerate oligonucleotide primer
  primer_bind (1)..(32)
  modified_base (1)..(1): base is a locked nucleic acid
  modified_base (6)..(6): base is a locked nucleic acid
  modified_base (10)..(10): base is a locked nucleic acid
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14652 - DNA, 32 bp, Artificial Sequence; identical to SEQ ID NO: 14650
  Pan degenerate oligonucleotide primer
  primer_bind (1)..(32)
  modified_base (1)..(1): base is a locked nucleic acid
  modified_base (3)..(3): base is a locked nucleic acid
  modified_base (10)..(10): base is a locked nucleic acid
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14653 - DNA, 30 bp, Artificial Sequence
  Pan degenerate oligonucleotide primer
  primer_bind (1)..(30)
  modified_base (1)..(1): base is a locked nucleic acid
  modified_base (4)..(4): base is a locked nucleic acid
  modified_base (8)..(8): base is a locked nucleic acid
  misc_feature (24)..(30): Adaptor region of the pan degenerate sense primer that adapts the probe-binding site upstream of codon 148 to correspond to the nucleotides in an oligonucleotide probe upstream of the discriminating single nucleotide polymorphism.
gaatttggvatyccctacaatccccaaagy

SEQ ID NO: 14654 - DNA, 30 bp, Artificial Sequence; identical to SEQ ID NO: 14653
  Pan degenerate oligonucleotide primer
  primer_bind (1)..(30)
  modified_base (1)..(1): base is a locked nucleic acid
  modified_base (8)..(8): base is a locked nucleic acid
  modified_base (11)..(11): base is a locked nucleic acid
  misc_feature (24)..(30): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14655 - DNA, 30 bp, Artificial Sequence; identical to SEQ ID NO: 14653
  Pan degenerate oligonucleotide primer
  primer_bind (1)..(30)
  modified_base (1)..(1): base is a locked nucleic acid
  modified_base (4)..(4): base is a locked nucleic acid
  modified_base (11)..(11): base is a locked nucleic acid
  misc_feature (24)..(30): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14656 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (8)..(8): base is a locked nucleic acid
  misc_feature (21)..(27): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagy

SEQ ID NO: 14657 - DNA, 27 bp, Artificial Sequence
  Pan degenerate oligonucleotide primer
  primer_bind (1)..(27)
  modified_base (1)..(1): base is a locked nucleic acid
  modified_base (8)..(8): base is a locked nucleic acid
  modified_base (10)..(10): base is a locked nucleic acid
  misc_feature (21)..(27): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagy

SEQ ID NO: 14658 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (10)..(10): base is a locked nucleic acid
  misc_feature (21)..(27): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagy

SEQ ID NO: 14659 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (6)..(6): base is a locked nucleic acid
  misc_feature (17)..(23): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagy

SEQ ID NO: 14660 - DNA, 23 bp, Artificial Sequence
  Pan degenerate oligonucleotide primer
  primer_bind (1)..(23)
  modified_base (1)..(1): base is a locked nucleic acid
  modified_base (6)..(6): base is a locked nucleic acid
  modified_base (7)..(7): base is a locked nucleic acid
  misc_feature (17)..(23): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagy

SEQ ID NO: 14661 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (7)..(7): base is a locked nucleic acid
  misc_feature (17)..(23): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagy

SEQ ID NO: 14662 - DNA, 40 bp, Artificial Sequence
  Pan degenerate oligonucleotide primer
  primer_bind (1)..(40)
  modified_base (2)..(2): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.
rtcmmrcargaatttggvatyccctacaatccccaaagyc

SEQ ID NO: 14663 - DNA, 40 bp, Artificial Sequence; identical to SEQ ID NO: 14662
  Pan degenerate oligonucleotide primer
  primer_bind (1)..(40)
  modified_base (2)..(2): base is a locked nucleic acid
  modified_base (8)..(8): base is a locked nucleic acid
  modified_base (10)..(10): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14664 - DNA, 40 bp, Artificial Sequence; identical to SEQ ID NO: 14662
  Pan degenerate oligonucleotide primer
  primer_bind (1)..(40)
  modified_base (2)..(2): base is a locked nucleic acid
  modified_base (7)..(7): base is a locked nucleic acid
  modified_base (10)..(10): base is a locked nucleic acid
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14665 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.
cargaatttggvatyccctacaatccccaaagyc

SEQ ID NO: 14666 - DNA, 34 bp, Artificial Sequence; identical to SEQ ID NO: 14665
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14667 - DNA, 34 bp, Artificial Sequence; identical to SEQ ID NO: 14665
  Pan degenerate oligonucleotide primer
  primer_bind (1)..(34)
  modified_base (1)..(1): base is a locked nucleic acid
  modified_base (2)..(2): base is a locked nucleic acid
  modified_base (7)..(7): base is a locked nucleic acid
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14668 - DNA, 33 bp, Artificial Sequence
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.
argaatttggvatyccctacaatccccaaagyc

SEQ ID NO: 14669 - DNA, 33 bp, Artificial Sequence; identical to SEQ ID NO: 14668
  Pan degenerate oligonucleotide primer
  primer_bind (1)..(33)
  modified_base (1)..(1): base is a locked nucleic acid
  modified_base (6)..(6): base is a locked nucleic acid
  modified_base (10)..(10): base is a locked nucleic acid
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14670 - DNA, 33 bp, Artificial Sequence; identical to SEQ ID NO: 14668
  Pan degenerate oligonucleotide primer
  primer_bind (1)..(33)
  modified_base (1)..(1): base is a locked nucleic acid
  modified_base (3)..(3): base is a locked nucleic acid
  modified_base (10)..(10): base is a locked nucleic acid
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14671 - DNA, 31 bp, Artificial Sequence
  Pan degenerate oligonucleotide primer
  primer_bind (1)..(31)
  modified_base (1)..(1): base is a locked nucleic acid
  modified_base (4)..(4): base is a locked nucleic acid
  modified_base (8)..(8): base is a locked nucleic acid
  misc_feature (25)..(31): Adaptor region of the pan degenerate sense primer that adapts the probe-binding site upstream of codon 148 to correspond to the nucleotides in an oligonucleotide probe upstream of the discriminating single nucleotide polymorphism.
gaatttggvatyccctacaatccccaaagyc

SEQ ID NO: 14672 - DNA, 31 bp, Artificial Sequence; identical to SEQ ID NO: 14671
  Pan degenerate oligonucleotide primer
  primer_bind (1)..(31)
  modified_base (1)..(1): base is a locked nucleic acid
  modified_base (8)..(8): base is a locked nucleic acid
  modified_base (11)..(11): base is a locked nucleic acid
  misc_feature (25)..(31): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14673 - DNA, 31 bp, Artificial Sequence; identical to SEQ ID NO: 14671
  Pan degenerate oligonucleotide primer
  primer_bind (1)..(31)
  modified_base (1)..(1): base is a locked nucleic acid
  modified_base (4)..(4): base is a locked nucleic acid
  modified_base (11)..(11): base is a locked nucleic acid
  misc_feature (25)..(31): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14674 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (8)..(8): base is a locked nucleic acid
  misc_feature (22)..(28): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyc

SEQ ID NO: 14675 - DNA, 28 bp, Artificial Sequence
  Pan degenerate oligonucleotide primer
  primer_bind (1)..(28)
  modified_base (1)..(1): base is a locked nucleic acid
  modified_base (8)..(8): base is a locked nucleic acid
  modified_base (10)..(10): base is a locked nucleic acid
  misc_feature (22)..(28): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyc

SEQ ID NO: 14676 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (10)..(10): base is a locked nucleic acid
  misc_feature (22)..(28): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyc

SEQ ID NO: 14677 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (6)..(6): base is a locked nucleic acid
  misc_feature (18)..(24): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyc

SEQ ID NO: 14678 - DNA, 24 bp, Artificial Sequence
  Pan degenerate oligonucleotide primer
  primer_bind (1)..(24)
  modified_base (1)..(1): base is a locked nucleic acid
  modified_base (6)..(6): base is a locked nucleic acid
  modified_base (7)..(7): base is a locked nucleic acid
  misc_feature (18)..(24): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyc

SEQ ID NO: 14679 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyc

SEQ ID NO: 14680 - DNA, 40 bp, Artificial Sequence; identical to SEQ ID NO: 14626
  Pan degenerate oligonucleotide primer
  primer_bind (1)..(40)
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14681 - DNA, 35 bp, Artificial Sequence; identical to SEQ ID NO: 14629
  Pan degenerate oligonucleotide primer
  primer_bind (1)..(35)
  misc_feature (29)..(35): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14682 - DNA, 34 bp, Artificial Sequence; identical to SEQ ID NO: 14632
  Pan degenerate oligonucleotide primer
  primer_bind (1)..(34)
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14683 - DNA, 32 bp, Artificial Sequence; identical to SEQ ID NO: 14635
  Pan degenerate oligonucleotide primer
  primer_bind (1)..(32)
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14684 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyca

SEQ ID NO: 14685 - DNA, 25 bp, Artificial Sequence
  Pan degenerate oligonucleotide primer
  primer_bind (1)..(25)
  misc_feature (19)..(25): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyca

SEQ ID NO: 14686 - DNA, 40 bp, Artificial Sequence; identical to SEQ ID NO: 14644
  Pan degenerate oligonucleotide primer
  primer_bind (1)..(40)
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14687 - DNA, 33 bp, Artificial Sequence; identical to SEQ ID NO: 14647
  Pan degenerate oligonucleotide primer
  primer_bind (1)..(33)
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14688 - DNA, 32 bp, Artificial Sequence; identical to SEQ ID NO: 14650
  Pan degenerate oligonucleotide primer
  primer_bind (1)..(32)
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14689 - DNA, 30 bp, Artificial Sequence; identical to SEQ ID NO: 14653
  Pan degenerate oligonucleotide primer
  primer_bind (1)..(30)
  misc_feature (24)..(30): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14690 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagy

SEQ ID NO: 14691 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagy

SEQ ID NO: 14692 - DNA, 40 bp, Artificial Sequence; identical to SEQ ID NO: 14662
  Pan degenerate oligonucleotide primer
  primer_bind (1)..(40)
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14693 - DNA, 34 bp, Artificial Sequence; identical to SEQ ID NO: 14665
  Pan degenerate oligonucleotide primer
  primer_bind (1)..(34)
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14694 - DNA, 33 bp, Artificial Sequence; identical to SEQ ID NO: 14668
  Pan degenerate oligonucleotide primer
  primer_bind (1)..(33)
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14695 - DNA, 31 bp, Artificial Sequence; identical to SEQ ID NO: 14671
  Pan degenerate oligonucleotide primer
  primer_bind (1)..(31)
  misc_feature (25)..(31): Adaptor region of the pan degenerate sense primer that adapts the probe-binding site upstream of codon 148 to correspond to the nucleotides in an oligonucleotide probe upstream of the discriminating single nucleotide polymorphism.

SEQ ID NO: 14696 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 148 to correspond to the nucleotides in an oligonucleotide probe upstream of the discriminating single nucleotide polymorphism.
tttggvatyccctacaatccccaaagyc

SEQ ID NO: 14697 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 148 to correspond to the nucleotides in an oligonucleotide probe upstream of the discriminating single nucleotide polymorphism.
gvatyccctacaatccccaaagyc

SEQ ID NO: 14698 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 148 to correspond to the nucleotides in an oligonucleotide probe upstream of the discriminating single nucleotide polymorphism.
gcvrrdrtymvrcargartttggvatyccctacaatccycaaagt

SEQ ID NO: 14699 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
tcmmrcargaatttggvatyccctacaatccccaaagycan

SEQ ID NO: 14700 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 148 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
cargaatttggvatyccctacaatccccaaagycan

SEQ ID NO: 14701 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
argaatttggvatyccctacaatccccaaagycan

SEQ ID NO: 14702 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
gaatttggvatyccctacaatccccaaagycan

SEQ ID NO: 14703 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 148 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
tttggvatyccctacaatccccaaagycan

SEQ ID NO: 14704 - DNA, 26 bp, Artificial Sequence
  Pan degenerate oligonucleotide primer
  primer_bind (1)..(26)
  misc_feature (19)..(25): Adaptor region of the pan degenerate sense primer that adapts the probe-binding site upstream of codon 148 to correspond to the nucleotides in an oligonucleotide probe upstream of the discriminating single nucleotide polymorphism.
  modified_base (26)..(26): base is a locked nucleic acid
  misc_feature (26)..(26): n is a, c, g, or t
gvatyccctacaatccccaaagycan

SEQ ID NO: 14705 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
brtcmmrcargaatttggvatyccctacaatccccaaagyn

SEQ ID NO: 14706 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cargaatttggvatyccctacaatccccaaagyn

SEQ ID NO: 14707 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 148 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
argaatttggvatyccctacaatccccaaagyn

SEQ ID NO: 14708 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 148 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
gaatttggvatyccctacaatccccaaagyn

SEQ ID NO: 14709 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 148 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
tttggvatyccctacaatccccaaagyn

SEQ ID NO: 14710 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 148 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
gvatyccctacaatccccaaagyn

SEQ ID NO: 14711 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 148 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rtcmmrcargaatttggvatyccctacaatccccaaagycn

SEQ ID NO: 14712 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 148 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
cargaatttggvatyccctacaatccccaaagycn

SEQ ID NO: 14713 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 148 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
argaatttggvatyccctacaatccccaaagycn

SEQ ID NO: 14714 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 148 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
gaatttggvatyccctacaatccccaaagycn

SEQ ID NO: 14715 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 148 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
tttggvatyccctacaatccccaaagycn

SEQ ID NO: 14716 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 148 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
gvatyccctacaatccccaaagycn

SEQ ID NO: 14717 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 148 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gcvrrdrtymvrcargartttggvatyccctacaatccycaaagtn

SEQ ID NO: 14718 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 153 to correspond to the nucleotides in an oligonucleotide probe upstream of the discriminating single nucleotide polymorphism.
gartttggvatyccctacaatccycaaagycarggagtagtagaa

SEQ ID NO: 14719 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 153 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gartttggvatyccctacaatccycaaagycarggagtagtagaan

SEQ ID NO: 14720 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.
yccctacaatccccaaagycarggagtagtrgartcyatg

SEQ ID NO: 14721 - DNA, 40 bp, Artificial Sequence; identical to SEQ ID NO: 14720
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14722 - DNA, 40 bp, Artificial Sequence; identical to SEQ ID NO: 14720
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14723 - DNA, 38 bp, Artificial Sequence
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 155 to correspond to the nucleotides in an oligonucleotide probe upstream of the discriminating single nucleotide polymorphism.
cctacaatccccaaagycarggagtagtrgartcyatg

SEQ ID NO: 14724 - DNA, 38 bp, Artificial Sequence; identical to SEQ ID NO: 14723
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14725 - DNA, 38 bp, Artificial Sequence; identical to SEQ ID NO: 14723
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14726 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.
tacaatccccaaagycarggagtagtrgartcyatg

SEQ ID NO: 14727 - DNA, 36 bp, Artificial Sequence; identical to SEQ ID NO: 14726
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14728 - DNA, 36 bp, Artificial Sequence; identical to SEQ ID NO: 14726
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14729 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 155 to correspond to the nucleotides in an oligonucleotide probe upstream of the discriminating single nucleotide polymorphism.
acaatccccaaagycarggagtagtrgartcyatg

SEQ ID NO: 14730 - DNA, 35 bp, Artificial Sequence; identical to SEQ ID NO: 14729
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14731 - DNA, 35 bp, Artificial Sequence; identical to SEQ ID NO: 14729
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14732 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.
aatccccaaagycarggagtagtrgartcyatg

SEQ ID NO: 14733 - DNA, 33 bp, Artificial Sequence; identical to SEQ ID NO: 14732
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14734 - DNA, 33 bp, Artificial Sequence; identical to SEQ ID NO: 14732
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14735 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 155 to correspond to the nucleotides in an oligonucleotide probe upstream of the discriminating single nucleotide polymorphism.
atccccaaagycarggagtagtrgartcyatg

SEQ ID NO: 14736 - DNA, 32 bp, Artificial Sequence; identical to SEQ ID NO: 14735
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14737 - DNA, 32 bp, Artificial Sequence; identical to SEQ ID NO: 14735
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14738 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.
ccctacaatccccaaagycarggagtagtrgartcyatga

SEQ ID NO: 14739 - DNA, 40 bp, Artificial Sequence; identical to SEQ ID NO: 14738
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14740 - DNA, 40 bp, Artificial Sequence; identical to SEQ ID NO: 14738
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14741 - DNA, 39 bp, Artificial Sequence
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 155 to correspond to the nucleotides in an oligonucleotide probe upstream of the discriminating single nucleotide polymorphism.
cctacaatccccaaagycarggagtagtrgartcyatga

SEQ ID NO: 14742 - DNA, 39 bp, Artificial Sequence; identical to SEQ ID NO: 14741
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (33)..(39): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14743 - DNA, 39 bp, Artificial Sequence; identical to SEQ ID NO: 14741
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (33)..(39): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14744 - DNA, 37 bp, Artificial Sequence
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate sense primer that adapts the probe-binding site upstream of codon 155 to correspond to the nucleotides in an oligonucleotide probe upstream of the discriminating single nucleotide polymorphism.
tacaatccccaaagycarggagtagtrgartcyatga

SEQ ID NO: 14745 - DNA, 37 bp, Artificial Sequence; identical to SEQ ID NO: 14744
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14746 - DNA, 37 bp, Artificial Sequence; identical to SEQ ID NO: 14744
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14747 - DNA, 36 bp, Artificial Sequence
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.
acaatccccaaagycarggagtagtrgartcyatga

SEQ ID NO: 14748 - DNA, 36 bp, Artificial Sequence; identical to SEQ ID NO: 14747
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14749 - DNA, 36 bp, Artificial Sequence; identical to SEQ ID NO: 14747
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14750 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 155 to correspond to the nucleotides in an oligonucleotide probe upstream of the discriminating single nucleotide polymorphism.
aatccccaaagycarggagtagtrgartcyatga

SEQ ID NO: 14751 - DNA, 34 bp, Artificial Sequence; identical to SEQ ID NO: 14750
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14752 - DNA, 34 bp, Artificial Sequence; identical to SEQ ID NO: 14750
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14753 - DNA, 33 bp, Artificial Sequence
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.
atccccaaagycarggagtagtrgartcyatga

SEQ ID NO: 14754 - DNA, 33 bp, Artificial Sequence; identical to SEQ ID NO: 14753
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14755 - DNA, 33 bp, Artificial Sequence; identical to SEQ ID NO: 14753
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14756 - DNA, 40 bp, Artificial Sequence; identical to SEQ ID NO: 14720
  Pan degenerate oligonucleotide primer
  primer_bind (1)..(40)
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14757 - DNA, 38 bp, Artificial Sequence; identical to SEQ ID NO: 14723
  Pan degenerate oligonucleotide primer
  primer_bind (1)..(38)
  misc_feature (32)..(38): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14758 - DNA, 36 bp, Artificial Sequence; identical to SEQ ID NO: 14726
  Pan degenerate oligonucleotide primer
  primer_bind (1)..(36)
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14759 - DNA, 35 bp, Artificial Sequence; identical to SEQ ID NO: 14729
  Pan degenerate oligonucleotide primer
  primer_bind (1)..(35)
  misc_feature (29)..(35): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14760 - DNA, 33 bp, Artificial Sequence; identical to SEQ ID NO: 14732
  Pan degenerate oligonucleotide primer
  primer_bind (1)..(33)
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14761 - DNA, 32 bp, Artificial Sequence; identical to SEQ ID NO: 14735
  Pan degenerate oligonucleotide primer
  primer_bind (1)..(32)
  misc_feature (26)..(32): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14762 - DNA, 40 bp, Artificial Sequence; identical to SEQ ID NO: 14738
  Pan degenerate oligonucleotide primer
  primer_bind (1)..(40)
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14763 - DNA, 39 bp, Artificial Sequence; identical to SEQ ID NO: 14741
  Pan degenerate oligonucleotide primer
  primer_bind (1)..(39)
  misc_feature (33)..(39): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14764 - DNA, 37 bp, Artificial Sequence; identical to SEQ ID NO: 14744
  Pan degenerate oligonucleotide primer
  primer_bind (1)..(37)
  misc_feature (31)..(37): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14765 - DNA, 36 bp, Artificial Sequence; identical to SEQ ID NO: 14747
  Pan degenerate oligonucleotide primer
  primer_bind (1)..(36)
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14766 - DNA, 34 bp, Artificial Sequence; identical to SEQ ID NO: 14750
  Pan degenerate oligonucleotide primer
  primer_bind (1)..(34)
  misc_feature (28)..(34): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14767 - DNA, 33 bp, Artificial Sequence; identical to SEQ ID NO: 14753
  Pan degenerate oligonucleotide primer
  primer_bind (1)..(33)
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.

SEQ ID NO: 14768 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 155 to correspond to the nucleotides in an oligonucleotide probe upstream of the discriminating single nucleotide polymorphism.
ggvatyccctacaatccycaaagycarggagtagtrgartctatg

SEQ ID NO: 14769 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
yccctacaatccccaaagycarggagtagtrgartcyatgn

SEQ ID NO: 14770 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 155 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
cctacaatccccaaagycarggagtagtrgartcyatgn

SEQ ID NO: 14771 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
tacaatccccaaagycarggagtagtrgartcyatgn

SEQ ID NO: 14772 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 155 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
acaatccccaaagycarggagtagtrgartcyatgn

SEQ ID NO: 14773 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
aatccccaaagycarggagtagtrgartcyatgn

SEQ ID NO: 14774 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 155 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
atccccaaagycarggagtagtrgartcyatgn

SEQ ID NO: 14775 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 155 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ccctacaatccccaaagycarggagtagtrgartcyatgan

SEQ ID NO: 14776 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 155 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
cctacaatccccaaagycarggagtagtrgartcyatgan

SEQ ID NO: 14777 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 155 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
tacaatccccaaagycarggagtagtrgartcyatgan

SEQ ID NO: 14778 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 155 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
acaatccccaaagycarggagtagtrgartcyatgan

SEQ ID NO: 14779 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 155 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
aatccccaaagycarggagtagtrgartcyatgan

SEQ ID NO: 14780 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 155 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
atccccaaagycarggagtagtrgartcyatgan

SEQ ID NO: 14781 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 155 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ggvatyccctacaatccycaaagycarggagtagtrgartctatgn

SEQ ID NO: 14782 - DNA, 40 bp, Artificial Sequence
  Pan degenerate oligonucleotide primer
  primer_bind (1)..(40)
  modified_base (2)..(2): base is a locked nucleic acid
  modified_base (9)..(9): base is a locked nucleic acid
  modified_base (18)..(18): base is a locked nucleic acid
  misc_feature (34)..(40): Adaptor region of the pan degenerate sense primer that adapts the probe-binding site upstream of codon 163 to correspond to the nucleotides in an oligonucleotide probe upstream of the discriminating single nucleotide polymorphism.
agtagtrgartcyatgaataargaattaaagaaaatyata

SEQ ID NO: 14783 - DNA, 40 bp, Artificial Sequence; identical to SEQ ID NO: 14782
  Pan degenerate oligonucleotide primer
  primer_bind (1)..(40)
  modified_base (2)..(2): base is a locked nucleic acid
  modified_base (18)..(18): base is a locked nucleic acid
  modified_base (27)..(27): base is a locked nucleic acid
  misc_feature (34)..(40): Adaptor region of the pan degenerate sense primer that adapts the probe-binding site upstream of codon 163 to correspond to the nucleotides in an oligonucleotide probe upstream of the discriminating single nucleotide polymorphism.

SEQ ID NO: 14784 - DNA, 40 bp, Artificial Sequence; identical to SEQ ID NO: 14782
  Pan degenerate oligonucleotide primer
  primer_bind (1)..(40)
  modified_base (2)..(2): base is a locked nucleic acid
  modified_base (9)..(9): base is a locked nucleic acid
  modified_base (27)..(27): base is a locked nucleic acid
  misc_feature (34)..(40): Adaptor region of the pan degenerate sense primer that adapts the probe-binding site upstream of codon 163 to correspond to the nucleotides in an oligonucleotide probe upstream of the discriminating single nucleotide polymorphism.

SEQ ID NO: 14785 - DNA, 32 bp, Artificial Sequence
  Pan degenerate oligonucleotide primer
  primer_bind (1)..(32)
  modified_base (1)..(1): base is a locked nucleic acid
  modified_base (10)..(10): base is a locked nucleic acid
  modified_base (19)..(19): base is a locked nucleic acid
  misc_feature (26)..(32): Adaptor region of the pan degenerate sense primer that adapts the probe-binding site upstream of codon 163 to correspond to the nucleotides in an oligonucleotide probe upstream of the discriminating single nucleotide polymorphism.
artcyatgaataargaattaaagaaaatyata

SEQ ID NO: 14786 - DNA, 32 bp, Artificial Sequence; identical to SEQ ID NO: 14785
  Pan degenerate oligonucleotide primer
  primer_bind (1)..(32)
  modified_base (1)..(1): base is a locked nucleic acid
  modified_base (19)..(19): base is a locked nucleic acid
  modified_base (21)..(21): base is a locked nucleic acid
  misc_feature (26)..(32): Adaptor region of the pan degenerate sense primer that adapts the probe-binding site upstream of codon 163 to correspond to the nucleotides in an oligonucleotide probe upstream of the discriminating single nucleotide polymorphism.

SEQ ID NO: 14787 - DNA, 32 bp, Artificial Sequence; identical to SEQ ID NO: 14785
  Pan degenerate oligonucleotide primer
  primer_bind (1)..(32)
  modified_base (1)..(1): base is a locked nucleic acid
  modified_base (10)..(10): base is a locked nucleic acid
  modified_base (21)..(21): base is a locked nucleic acid
  misc_feature (26)..(32): Adaptor region of the pan degenerate sense primer that adapts the probe-binding site upstream of codon 163 to correspond to the nucleotides in an oligonucleotide probe upstream of the discriminating single nucleotide polymorphism.

SEQ ID NO: 14788 - DNA, 23 bp, Artificial Sequence
  Pan degenerate oligonucleotide primer
  primer_bind (1)..(23)
  modified_base (1)..(1): base is a locked nucleic acid
  modified_base (10)..(10): base is a locked nucleic acid
  modified_base (12)..(12): base is a locked nucleic acid
  misc_feature (17)..(23): Adaptor region of the pan degenerate sense primer that adapts the probe-binding site upstream of codon 163 to correspond to the nucleotides in an oligonucleotide probe upstream of the discriminating single nucleotide polymorphism.
ataargaattaaagaaaatyata

SEQ ID NO: 14789 - DNA, 23 bp, Artificial Sequence
  Pan degenerate oligonucleotide primer
  primer_bind (1)..(23)
  modified_base (1)..(1): base is a locked nucleic acid
  modified_base (12)..(12): base is a locked nucleic acid
  misc_feature (17)..(23): Adaptor region of the pan degenerate sense primer that adapts the probe-binding site upstream of codon 163 to correspond to the nucleotides in an oligonucleotide probe upstream of the discriminating single nucleotide polymorphism.
  modified_base (19)..(19): base is a locked nucleic acid
ataargaattaaagaaaatyata

SEQ ID NO: 14790 - DNA, 23 bp, Artificial Sequence
  Pan degenerate oligonucleotide primer
  primer_bind (1)..(23)
  modified_base (1)..(1): base is a locked nucleic acid
  modified_base (10)..(10): base is a locked nucleic acid
  misc_feature (17)..(23): Adaptor region of the pan degenerate sense primer that adapts the probe-binding site upstream of codon 163 to correspond to the nucleotides in an oligonucleotide probe upstream of the discriminating single nucleotide polymorphism.
  modified_base (19)..(19): base is a locked nucleic acid
ataargaattaaagaaaatyata

SEQ ID NO: 14791 - DNA, 40 bp, Artificial Sequence; identical to SEQ ID NO: 14782
  Pan degenerate oligonucleotide primer
  primer_bind (1)..(40)
  misc_feature (34)..(40): Adaptor region of the pan degenerate sense primer that adapts the probe-binding site upstream of codon 163 to correspond to the nucleotides in an oligonucleotide probe upstream of the discriminating single nucleotide polymorphism.

SEQ ID NO: 14792 - DNA, 32 bp, Artificial Sequence; identical to SEQ ID NO: 14785
  Pan degenerate oligonucleotide primer
  primer_bind (1)..(32)
  misc_feature (26)..(32): Adaptor region of the pan degenerate sense primer that adapts the probe-binding site upstream of codon 163 to correspond to the nucleotides in an oligonucleotide probe upstream of the discriminating single nucleotide polymorphism.

SEQ ID NO: 14793 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 163 to correspond to the nucleotides in an oligonucleotide probe upstream of the discriminating single nucleotide polymorphism.
ataargaattaaagaaaatyata

SEQ ID NO: 14794 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 163 to correspond to the nucleotides in an oligonucleotide probe upstream of the discriminating single nucleotide polymorphism.
carggagtagtrgartcyatgaataadgarttaaagaarattata

SEQ ID NO: 14795 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 163 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
agtagtrgartcyatgaataargaattaaagaaaatyatan

SEQ ID NO: 14796 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 163 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
artcyatgaataargaattaaagaaaatyatan

SEQ ID NO: 14797 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 163 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
ataargaattaaagaaaatyatan

SEQ ID NO: 14798 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 163 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
carggagtagtrgartcyatgaataadgarttaaagaarattatan

SEQ ID NO: 14799 - DNA, 40 bp, Artificial Sequence
  Pan degenerate oligonucleotide primer
  primer_bind (1)..(40)
  modified_base (3)..(3): base is a locked nucleic acid
  modified_base (12)..(12): base is a locked nucleic acid
  modified_base (20)..(20): base is a locked nucleic acid
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.
aattwyaaaaattcaaaattttcgggtttattacagrgac

SEQ ID NO: 14800 - DNA, 40 bp, Artificial Sequence; identical to SEQ ID NO: 14799
  Pan degenerate oligonucleotide primer
  primer_bind (1)..(40)
  modified_base (3)..(3): base is a locked nucleic acid
  modified_base (20)..(20): base is a locked nucleic acid
  modified_base (21)..(21): base is a locked nucleic acid
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 14801 - DNA, 40 bp, Artificial Sequence; identical to SEQ ID NO: 14799
  Pan degenerate oligonucleotide primer
  primer_bind (1)..(40)
  modified_base (3)..(3): base is a locked nucleic acid
  modified_base (12)..(12): base is a locked nucleic acid
  modified_base (21)..(21): base is a locked nucleic acid
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 14802 - DNA, 29 bp, Artificial Sequence
  Pan degenerate oligonucleotide primer
  primer_bind (1)..(29)
  modified_base (1)..(1): base is a locked nucleic acid
  modified_base (9)..(9): base is a locked nucleic acid
  modified_base (10)..(10): base is a locked nucleic acid
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
ttcaaaattttcgggtttattacagrgac

SEQ ID NO: 14803 - DNA, 29 bp, Artificial Sequence
  Pan degenerate oligonucleotide primer
  primer_bind (1)..(29)
  modified_base (1)..(1): base is a locked nucleic acid
  modified_base (10)..(10): base is a locked nucleic acid
  modified_base (12)..(12): base is a locked nucleic acid
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
ttcaaaattttcgggtttattacagrgac

SEQ ID NO: 14804 - DNA, 29 bp, Artificial Sequence
  Pan degenerate oligonucleotide primer
  primer_bind (1)..(29)
  modified_base (1)..(1): base is a locked nucleic acid
  modified_base (9)..(9): base is a locked nucleic acid
  modified_base (12)..(12): base is a locked nucleic acid
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
ttcaaaattttcgggtttattacagrgac

SEQ ID NO: 14805 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (4)..(4): base is a locked nucleic acid
  misc_feature (15)..(21): Adaptor region of the pan degenerate sense primer that adapts the probe-binding site upstream of codon 230 to correspond to the nucleotides in an oligonucleotide probe upstream of the discriminating single nucleotide polymorphism.
tttcgggtttattacagrgac

SEQ ID NO: 14806 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (6)..(6): base is a locked nucleic acid
  misc_feature (15)..(21): Adaptor region of the pan degenerate sense primer that adapts the probe-binding site upstream of codon 230 to correspond to the nucleotides in an oligonucleotide probe upstream of the discriminating single nucleotide polymorphism.
tttcgggtttattacagrgac

SEQ ID NO: 14807 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (6)..(6): base is a locked nucleic acid
  misc_feature (15)..(21): Adaptor region of the pan degenerate sense primer that adapts the probe-binding site upstream of codon 230 to correspond to the nucleotides in an oligonucleotide probe upstream of the discriminating single nucleotide polymorphism.
tttcgggtttattacagrgac

SEQ ID NO: 14808 - DNA, 40 bp, Artificial Sequence; identical to SEQ ID NO: 14799
  Pan degenerate oligonucleotide primer
  primer_bind (1)..(40)
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 14809 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
ttcaaaattttcgggtttattacagrgac

SEQ ID NO: 14810 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 230 to correspond to the nucleotides in an oligonucleotide probe upstream of the discriminating single nucleotide polymorphism.
tttcgggtttattacagrgac

SEQ ID NO: 14811 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 230 to correspond to the nucleotides in an oligonucleotide probe upstream of the discriminating single nucleotide polymorphism.
aamcarattwyaaaaattcaaaattttcgggtttattacagggac

SEQ ID NO: 14812 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aattwyaaaaattcaaaattttcgggtttattacagrgacn

SEQ ID NO: 14813 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
ttcaaaattttcgggtttattacagrgacn

SEQ ID NO: 14814 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 230 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
tttcgggtttattacagrgacn

SEQ ID NO: 14815 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 230 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aamcarattwyaaaaattcaaaattttcgggtttattacagggacn

SEQ ID NO: 14816 - DNA, 40 bp, Artificial Sequence
  Pan degenerate oligonucleotide primer
  primer_bind (1)..(40)
  modified_base (5)..(5): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 263 to correspond to the nucleotides in an oligonucleotide probe upstream of the discriminating single nucleotide polymorphism.
gtrmtacargayaayarygahataaargtagtrccaagra

SEQ ID NO: 14817 - DNA, 40 bp, Artificial Sequence; identical to SEQ ID NO: 14816
  Pan degenerate oligonucleotide primer
  primer_bind (1)..(40)
  modified_base (5)..(5): base is a locked nucleic acid
  modified_base (8)..(8): base is a locked nucleic acid
  modified_base (11)..(11): base is a locked nucleic acid
  misc_feature (34)..(40): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14818 - DNA, 40 bp, Artificial Sequence; identical to SEQ ID NO: 14816
  Pan degenerate oligonucleotide primer
  primer_bind (1)..(40)
  modified_base (5)..(5): base is a locked nucleic acid
  modified_base (7)..(7): base is a locked nucleic acid
  modified_base (11)..(11): base is a locked nucleic acid
  misc_feature (34)..(40): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14819 - DNA, 34 bp, Artificial Sequence
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 263 to correspond to the nucleotides in an oligonucleotide probe upstream of the discriminating single nucleotide polymorphism.
cargayaayarygahataaargtagtrccaagra

SEQ ID NO: 14820 - DNA, 34 bp, Artificial Sequence; identical to SEQ ID NO: 14819
  Pan degenerate oligonucleotide primer
  primer_bind (1)..(34)
  modified_base (1)..(1): base is a locked nucleic acid
  modified_base (5)..(5): base is a locked nucleic acid
  modified_base (13)..(13): base is a locked nucleic acid
  misc_feature (28)..(34): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14821 - DNA, 34 bp, Artificial Sequence; identical to SEQ ID NO: 14819
  Pan degenerate oligonucleotide primer
  primer_bind (1)..(34)
  modified_base (1)..(1): base is a locked nucleic acid
  modified_base (2)..(2): base is a locked nucleic acid
  modified_base (13)..(13): base is a locked nucleic acid
  misc_feature (28)..(34): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14822 - DNA, 33 bp, Artificial Sequence
  Pan degenerate oligonucleotide primer
  primer_bind (1)..(33)
  modified_base (1)..(1): base is a locked nucleic acid
  modified_base (4)..(4): base is a locked nucleic acid
  modified_base (12)..(12): base is a locked nucleic acid
  misc_feature (27)..(33): Adaptor region of the pan degenerate sense primer that adapts the probe-binding site upstream of codon 263 to correspond to the nucleotides in an oligonucleotide probe upstream of the discriminating single nucleotide polymorphism.
argayaayarygahataaargtagtrccaagra

SEQ ID NO: 14823 - DNA, 33 bp, Artificial Sequence; identical to SEQ ID NO: 14822
  Pan degenerate oligonucleotide primer
  primer_bind (1)..(33)
  modified_base (1)..(1): base is a locked nucleic acid
  modified_base (12)..(12): base is a locked nucleic acid
  modified_base (16)..(16): base is a locked nucleic acid
  misc_feature (27)..(33): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14824 - DNA, 33 bp, Artificial Sequence; identical to SEQ ID NO: 14822
  Pan degenerate oligonucleotide primer
  primer_bind (1)..(33)
  modified_base (1)..(1): base is a locked nucleic acid
  modified_base (4)..(4): base is a locked nucleic acid
  modified_base (16)..(16): base is a locked nucleic acid
  misc_feature (27)..(33): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14825 - DNA, 30 bp, Artificial Sequence
  Pan degenerate oligonucleotide primer
  primer_bind (1)..(30)
  modified_base (1)..(1): base is a locked nucleic acid
  modified_base (9)..(9): base is a locked nucleic acid
  modified_base (13)..(13): base is a locked nucleic acid
  misc_feature (24)..(30): Adaptor region of the pan degenerate sense primer that adapts the probe-binding site upstream of codon 263 to correspond to the nucleotides in an oligonucleotide probe upstream of the discriminating single nucleotide polymorphism.
ayaayarygahataaargtagtrccaagra

SEQ ID NO: 14826 - DNA, 30 bp, Artificial Sequence; identical to SEQ ID NO: 14825
  Pan degenerate oligonucleotide primer
  primer_bind (1)..(30)
  modified_base (1)..(1): base is a locked nucleic acid
  modified_base (13)..(13): base is a locked nucleic acid
  modified_base (15)..(15): base is a locked nucleic acid
  misc_feature (24)..(30): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14827 - DNA, 30 bp, Artificial Sequence; identical to SEQ ID NO: 14825
  Pan degenerate oligonucleotide primer
  primer_bind (1)..(30)
  modified_base (1)..(1): base is a locked nucleic acid
  modified_base (9)..(9): base is a locked nucleic acid
  modified_base (15)..(15): base is a locked nucleic acid
  misc_feature (24)..(30): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14828 - DNA, 22 bp, Artificial Sequence
  Pan degenerate oligonucleotide primer
  primer_bind (1)..(22)
  modified_base (1)..(1): base is a locked nucleic acid
  modified_base (5)..(5): base is a locked nucleic acid
  modified_base (7)..(7): base is a locked nucleic acid
  misc_feature (16)..(22): Adaptor region of the pan degenerate sense primer that adapts the probe-binding site upstream of codon 263 to correspond to the nucleotides in an oligonucleotide probe upstream of the discriminating single nucleotide polymorphism.
gahataaargtagtrccaagra

SEQ ID NO: 14829 - DNA, 22 bp, Artificial Sequence
  Pan degenerate oligonucleotide primer
  primer_bind (1)..(22)
  modified_base (1)..(1): base is a locked nucleic acid
  modified_base (7)..(7): base is a locked nucleic acid
  modified_base (8)..(8): base is a locked nucleic acid
  misc_feature (16)..(22): Adaptor region of the pan degenerate sense primer that adapts the probe-binding site upstream of codon 263 to correspond to the nucleotides in an oligonucleotide probe upstream of the discriminating single nucleotide polymorphism.
gahataaargtagtrccaagra

SEQ ID NO: 14830 - DNA, 22 bp, Artificial Sequence
  Pan degenerate oligonucleotide primer
  primer_bind (1)..(22)
  modified_base (1)..(1): base is a locked nucleic acid
  modified_base (5)..(5): base is a locked nucleic acid
  modified_base (8)..(8): base is a locked nucleic acid
  misc_feature (16)..(22): Adaptor region of the pan degenerate sense primer that adapts the probe-binding site upstream of codon 263 to correspond to the nucleotides in an oligonucleotide probe upstream of the discriminating single nucleotide polymorphism.
gahataaargtagtrccaagra

SEQ ID NO: 14831 - DNA, 40 bp, Artificial Sequence; identical to SEQ ID NO: 14816
  Pan degenerate oligonucleotide primer
  primer_bind (1)..(40)
  misc_feature (34)..(40): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14832 - DNA, 34 bp, Artificial Sequence; identical to SEQ ID NO: 14819
  Pan degenerate oligonucleotide primer
  primer_bind (1)..(34)
  misc_feature (28)..(34): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14833 - DNA, 33 bp, Artificial Sequence; identical to SEQ ID NO: 14822
  Pan degenerate oligonucleotide primer
  primer_bind (1)..(33)
  misc_feature (27)..(33): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14834 - DNA, 30 bp, Artificial Sequence; identical to SEQ ID NO: 14825
  Pan degenerate oligonucleotide primer
  primer_bind (1)..(30)
  misc_feature (24)..(30): Adaptor region of the pan degenerate sense primer that adapts the probe-binding site upstream of codon 263 to correspond to the nucleotides in an oligonucleotide probe upstream of the discriminating single nucleotide polymorphism.

SEQ ID NO: 14835 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 263 to correspond to the nucleotides in an oligonucleotide probe upstream of the discriminating single nucleotide polymorphism.
gahataaargtagtrccaagra

SEQ ID NO: 14836 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 263 to correspond to the nucleotides in an oligonucleotide probe upstream of the discriminating single nucleotide polymorphism.
gcagtagtvatacargayaayartgahataaargtagtrccaaga

SEQ ID NO: 14837 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 263 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gtrmtacargayaayarygahataaargtagtrccaagran

SEQ ID NO: 14838 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 263 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
cargayaayarygahataaargtagtrccaagran

SEQ ID NO: 14839 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 263 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
argayaayarygahataaargtagtrccaagran

SEQ ID NO: 14840 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 263 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
ayaayarygahataaargtagtrccaagran

SEQ ID NO: 14841 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 263 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
gahataaargtagtrccaagran

SEQ ID NO: 14842 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 263 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gcagtagtvatacargayaayartgahataaargtagtrccaagan

SEQ ID NO: 14843 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 51 to correspond to the nucleotides in an oligonucleotide probe downstream of the discriminating single nucleotide polymorphism.
arrtgtgtrcartctarytgccatatycctggrctrcartcyacytgtcc

SEQ ID NO: 14844 - DNA, 50 bp, Artificial Sequence; identical to SEQ ID NO: 14843
  Pan degenerate oligonucleotide primer
  primer_bind (1)..(50)
  misc_feature (44)..(50): Adaptor region of the pan degenerate antisense primer that adapts the probe-binding site downstream of codon 51 to correspond to the nucleotides in an oligonucleotide probe downstream of the discriminating single nucleotide polymorphism.

SEQ ID NO: 14845 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 51 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
arrtgtgtrcartctarytgccatatycctggrctrcartcyacytgtccn

SEQ ID NO: 14846 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.
acrtgractgctacyadratdaytttyccttctarrtgtg

SEQ ID NO: 14847 - DNA, 40 bp, Artificial Sequence; identical to SEQ ID NO: 14846
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14848 - DNA, 40 bp, Artificial Sequence; identical to SEQ ID NO: 14846
  Pan degenerate oligonucleotide primer
  primer_bind (1)..(40)
  modified_base (1)..(1): base is a locked nucleic acid
  modified_base (3)..(3): base is a locked nucleic acid
  modified_base (7)..(7): base is a locked nucleic acid
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14849 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.
rtgractgctacyadratdaytttyccttctarrtgtg

SEQ ID NO: 14850 - DNA, 38 bp, Artificial Sequence; identical to SEQ ID NO: 14849
  Pan degenerate oligonucleotide primer
  primer_bind (1)..(38)
  modified_base (1)..(1): base is a locked nucleic acid
  modified_base (5)..(5): base is a locked nucleic acid
  modified_base (7)..(7): base is a locked nucleic acid
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14851 - DNA, 38 bp, Artificial Sequence; identical to SEQ ID NO: 14849
  Pan degenerate oligonucleotide primer
  primer_bind (1)..(38)
  modified_base (1)..(1): base is a locked nucleic acid
  modified_base (2)..(2): base is a locked nucleic acid
  modified_base (7)..(7): base is a locked nucleic acid
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14852 - DNA, 37 bp, Artificial Sequence
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 66 to correspond to the nucleotides in an oligonucleotide probe downstream of the discriminating single nucleotide polymorphism.
tgractgctacyadratdaytttyccttctarrtgtg

SEQ ID NO: 14853 - DNA, 37 bp, Artificial Sequence; identical to SEQ ID NO: 14852
  Pan degenerate oligonucleotide primer
  primer_bind (1)..(37)
  modified_base (1)..(1): base is a locked nucleic acid
  modified_base (6)..(6): base is a locked nucleic acid
  modified_base (7)..(7): base is a locked nucleic acid
  misc_feature (31)..(37): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14854 - DNA, 37 bp, Artificial Sequence; identical to SEQ ID NO: 14852
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14855 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 66 to correspond to the nucleotides in an oligonucleotide probe downstream of the discriminating single nucleotide polymorphism.
actgctacyadratdaytttyccttctarrtgtg

SEQ ID NO: 14856 - DNA, 34 bp, Artificial Sequence; identical to SEQ ID NO: 14855
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14857 - DNA, 34 bp, Artificial Sequence; identical to SEQ ID NO: 14855
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14858 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.
tgctacyadratdaytttyccttctarrtgtg

SEQ ID NO: 14859 - DNA, 32 bp, Artificial Sequence; identical to SEQ ID NO: 14858
  Pan degenerate oligonucleotide primer
  primer_bind (1)..(32)
  modified_base (1)..(1): base is a locked nucleic acid
  modified_base (4)..(4): base is a locked nucleic acid
  modified_base (14)..(14): base is a locked nucleic acid
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14860 - DNA, 32 bp, Artificial Sequence; identical to SEQ ID NO: 14858
  Pan degenerate oligonucleotide primer
  primer_bind (1)..(32)
  modified_base (1)..(1): base is a locked nucleic acid
  modified_base (2)..(2): base is a locked nucleic acid
  modified_base (14)..(14): base is a locked nucleic acid
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14861 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (13)..(13): base is a locked nucleic acid
  misc_feature (25)..(31): Adaptor region of the pan degenerate antisense primer that adapts the probe-binding site downstream of codon 66 to correspond to the nucleotides in an oligonucleotide probe downstream of the discriminating single nucleotide polymorphism.
gctacyadratdaytttyccttctarrtgtg

SEQ ID NO: 14862 - DNA, 31 bp, Artificial Sequence; identical to SEQ ID NO: 14861
  Pan degenerate oligonucleotide primer
  primer_bind (1)..(31)
  modified_base (1)..(1): base is a locked nucleic acid
  modified_base (13)..(13): base is a locked nucleic acid
  modified_base (16)..(16): base is a locked nucleic acid
  misc_feature (25)..(31): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14863 - DNA, 31 bp, Artificial Sequence; identical to SEQ ID NO: 14861
  Pan degenerate oligonucleotide primer
  primer_bind (1)..(31)
  modified_base (1)..(1): base is a locked nucleic acid
  modified_base (3)..(3): base is a locked nucleic acid
  modified_base (16)..(16): base is a locked nucleic acid
  misc_feature (25)..(31): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14864 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.
yacrtgractgctacyadratdaytttyccttctarrtgt

SEQ ID NO: 14865 - DNA, 40 bp, Artificial Sequence; identical to SEQ ID NO: 14864
  Pan degenerate oligonucleotide primer
  primer_bind (1)..(40)
  modified_base (2)..(2): base is a locked nucleic acid
  modified_base (6)..(6): base is a locked nucleic acid
  modified_base (8)..(8): base is a locked nucleic acid
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14866 - DNA, 40 bp, Artificial Sequence; identical to SEQ ID NO: 14864
  Pan degenerate oligonucleotide primer
  primer_bind (1)..(40)
  modified_base (2)..(2): base is a locked nucleic acid
  modified_base (3)..(3): base is a locked nucleic acid
  modified_base (8)..(8): base is a locked nucleic acid
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14867 - DNA, 38 bp, Artificial Sequence
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.
crtgractgctacyadratdaytttyccttctarrtgt

SEQ ID NO: 14868 - DNA, 38 bp, Artificial Sequence; identical to SEQ ID NO: 14867
  Pan degenerate oligonucleotide primer
  primer_bind (1)..(38)
  modified_base (1)..(1): base is a locked nucleic acid
  modified_base (6)..(6): base is a locked nucleic acid
  modified_base (7)..(7): base is a locked nucleic acid
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14869 - DNA, 38 bp, Artificial Sequence; identical to SEQ ID NO: 14867
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14870 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 66 to correspond to the nucleotides in an oligonucleotide probe downstream of the discriminating single nucleotide polymorphism.
gractgctacyadratdaytttyccttctarrtgt

SEQ ID NO: 14871 - DNA, 35 bp, Artificial Sequence; identical to SEQ ID NO: 14870
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14872 - DNA, 35 bp, Artificial Sequence; identical to SEQ ID NO: 14870
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14873 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 66 to correspond to the nucleotides in an oligonucleotide probe downstream of the discriminating single nucleotide polymorphism.
actgctacyadratdaytttyccttctarrtgt

SEQ ID NO: 14874 - DNA, 33 bp, Artificial Sequence; identical to SEQ ID NO: 14873
  Pan degenerate oligonucleotide primer
  primer_bind (1)..(33)
  modified_base (1)..(1): base is a locked nucleic acid
  modified_base (4)..(4): base is a locked nucleic acid
  modified_base (14)..(14): base is a locked nucleic acid
  misc_feature (27)..(33): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14875 - DNA, 33 bp, Artificial Sequence; identical to SEQ ID NO: 14873
  Pan degenerate oligonucleotide primer
  primer_bind (1)..(33)
  modified_base (1)..(1): base is a locked nucleic acid
  modified_base (2)..(2): base is a locked nucleic acid
  modified_base (14)..(14): base is a locked nucleic acid
  misc_feature (27)..(33): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14876 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (13)..(13): base is a locked nucleic acid
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.
ctgctacyadratdaytttyccttctarrtgt

SEQ ID NO: 14877 - DNA, 32 bp, Artificial Sequence; identical to SEQ ID NO: 14876
  Pan degenerate oligonucleotide primer
  primer_bind (1)..(32)
  modified_base (1)..(1): base is a locked nucleic acid
  modified_base (13)..(13): base is a locked nucleic acid
  modified_base (16)..(16): base is a locked nucleic acid
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14878 - DNA, 32 bp, Artificial Sequence; identical to SEQ ID NO: 14876
  Pan degenerate oligonucleotide primer
  primer_bind (1)..(32)
  modified_base (1)..(1): base is a locked nucleic acid
  modified_base (3)..(3): base is a locked nucleic acid
  modified_base (16)..(16): base is a locked nucleic acid
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14879 - DNA, 30 bp, Artificial Sequence
  Pan degenerate oligonucleotide primer
  primer_bind (1)..(30)
  modified_base (1)..(1): base is a locked nucleic acid
  modified_base (11)..(11): base is a locked nucleic acid
  modified_base (14)..(14): base is a locked nucleic acid
  misc_feature (24)..(30): Adaptor region of the pan degenerate antisense primer that adapts the probe-binding site downstream of codon 66 to correspond to the nucleotides in an oligonucleotide probe downstream of the discriminating single nucleotide polymorphism.
gctacyadratdaytttyccttctarrtgt

SEQ ID NO: 14880 - DNA, 30 bp, Artificial Sequence; identical to SEQ ID NO: 14879
  Pan degenerate oligonucleotide primer
  primer_bind (1)..(30)
  modified_base (1)..(1): base is a locked nucleic acid
  modified_base (14)..(14): base is a locked nucleic acid
  modified_base (16)..(16): base is a locked nucleic acid
  misc_feature (24)..(30): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14881 - DNA, 30 bp, Artificial Sequence; identical to SEQ ID NO: 14879
  Pan degenerate oligonucleotide primer
  primer_bind (1)..(30)
  modified_base (1)..(1): base is a locked nucleic acid
  modified_base (11)..(11): base is a locked nucleic acid
  modified_base (16)..(16): base is a locked nucleic acid
  misc_feature (24)..(30): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14882 - DNA, 40 bp, Artificial Sequence; identical to SEQ ID NO: 14846
  Pan degenerate oligonucleotide primer
  primer_bind (1)..(40)
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14883 - DNA, 38 bp, Artificial Sequence; identical to SEQ ID NO: 14849
  Pan degenerate oligonucleotide primer
  primer_bind (1)..(38)
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14884 - DNA, 37 bp, Artificial Sequence; identical to SEQ ID NO: 14852
  Pan degenerate oligonucleotide primer
  primer_bind (1)..(37)
  misc_feature (31)..(37): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14885 - DNA, 34 bp, Artificial Sequence; identical to SEQ ID NO: 14855
  Pan degenerate oligonucleotide primer
  primer_bind (1)..(34)
  misc_feature (28)..(34): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14886 - DNA, 32 bp, Artificial Sequence; identical to SEQ ID NO: 14858
  Pan degenerate oligonucleotide primer
  primer_bind (1)..(32)
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14887 - DNA, 31 bp, Artificial Sequence; identical to SEQ ID NO: 14861
  Pan degenerate oligonucleotide primer
  primer_bind (1)..(31)
  misc_feature (25)..(31): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14888 - DNA, 40 bp, Artificial Sequence; identical to SEQ ID NO: 14864
  Pan degenerate oligonucleotide primer
  primer_bind (1)..(40)
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14889 - DNA, 38 bp, Artificial Sequence; identical to SEQ ID NO: 14867
  Pan degenerate oligonucleotide primer
  primer_bind (1)..(38)
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14890 - DNA, 35 bp, Artificial Sequence; identical to SEQ ID NO: 14870
  Pan degenerate oligonucleotide primer
  primer_bind (1)..(35)
  misc_feature (29)..(35): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14891 - DNA, 33 bp, Artificial Sequence; identical to SEQ ID NO: 14873
  Pan degenerate oligonucleotide primer
  primer_bind (1)..(33)
  misc_feature (27)..(33): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14892 - DNA, 32 bp, Artificial Sequence; identical to SEQ ID NO: 14876
  Pan degenerate oligonucleotide primer
  primer_bind (1)..(32)
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14893 - DNA, 30 bp, Artificial Sequence; identical to SEQ ID NO: 14879
  Pan degenerate oligonucleotide primer
  primer_bind (1)..(30)
  misc_feature (24)..(30): Adaptor region of the pan degenerate antisense primer that adapts the probe-binding site downstream of codon 66 to correspond to the nucleotides in an oligonucleotide probe downstream of the discriminating single nucleotide polymorphism.

SEQ ID NO: 14894 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 66 to correspond to the nucleotides in an oligonucleotide probe downstream of the discriminating single nucleotide polymorphism.
rtabccactrgcyacrtgractgctacyakratdaytttyccttctaaatg

SEQ ID NO: 14895 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
acrtgractgctacyadratdaytttyccttctarrtgtgn

SEQ ID NO: 14896 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
rtgractgctacyadratdaytttyccttctarrtgtgn

SEQ ID NO: 14897 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
tgractgctacyadratdaytttyccttctarrtgtgn

SEQ ID NO: 14898 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
actgctacyadratdaytttyccttctarrtgtgn

SEQ ID NO: 14899 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tgctacyadratdaytttyccttctarrtgtgn

SEQ ID NO: 14900 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
gctacyadratdaytttyccttctarrtgtgn

SEQ ID NO: 14901 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yacrtgractgctacyadratdaytttyccttctarrtgtn

SEQ ID NO: 14902 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
crtgractgctacyadratdaytttyccttctarrtgtn

SEQ ID NO: 14903 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
gractgctacyadratdaytttyccttctarrtgtn

SEQ ID NO: 14904 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
actgctacyadratdaytttyccttctarrtgtn

SEQ ID NO: 14905 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ctgctacyadratdaytttyccttctarrtgtn

SEQ ID NO: 14906 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
gctacyadratdaytttyccttctarrtgtn

SEQ ID NO: 14907 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 66 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rtabccactrgcyacrtgractgctacyakratdaytttyccttctaaatgn

SEQ ID NO: 14908 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.
tctgcttcyatrtadccactrgcyacrtgractgctacya

SEQ ID NO: 14909 - DNA, 40 bp, Artificial Sequence; identical to SEQ ID NO: 14908
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14910 - DNA, 40 bp, Artificial Sequence; identical to SEQ ID NO: 14908
  Pan degenerate oligonucleotide primer
  primer_bind (1)..(40)
  modified_base (1)..(1): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14911 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 74 to correspond to the nucleotides in an oligonucleotide probe downstream of the discriminating single nucleotide polymorphism.
tgcttcyatrtadccactrgcyacrtgractgctacya

SEQ ID NO: 14912 - DNA, 38 bp, Artificial Sequence; identical to SEQ ID NO: 14911
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14913 - DNA, 38 bp, Artificial Sequence; identical to SEQ ID NO: 14911
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14914 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.
gcttcyatrtadccactrgcyacrtgractgctacya

SEQ ID NO: 14915 - DNA, 37 bp, Artificial Sequence; identical to SEQ ID NO: 14914
  Pan degenerate oligonucleotide primer
  primer_bind (1)..(37)
  modified_base (1)..(1): base is a locked nucleic acid
  modified_base (4)..(4): base is a locked nucleic acid
  modified_base (9)..(9): base is a locked nucleic acid
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14916 - DNA, 37 bp, Artificial Sequence; identical to SEQ ID NO: 14914
  Pan degenerate oligonucleotide primer
  primer_bind (1)..(37)
  modified_base (1)..(1): base is a locked nucleic acid
  modified_base (3)..(3): base is a locked nucleic acid
  modified_base (9)..(9): base is a locked nucleic acid
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14917 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (7)..(7): base is a locked nucleic acid
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.
ttcyatrtadccactrgcyacrtgractgctacya

SEQ ID NO: 14918 - DNA, 35 bp, Artificial Sequence; identical to SEQ ID NO: 14917
  Pan degenerate oligonucleotide primer
  primer_bind (1)..(35)
  modified_base (1)..(1): base is a locked nucleic acid
  modified_base (7)..(7): base is a locked nucleic acid
  modified_base (8)..(8): base is a locked nucleic acid
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14919 - DNA, 35 bp, Artificial Sequence; identical to SEQ ID NO: 14917
  Pan degenerate oligonucleotide primer
  primer_bind (1)..(35)
  modified_base (1)..(1): base is a locked nucleic acid
  modified_base (2)..(2): base is a locked nucleic acid
  modified_base (8)..(8): base is a locked nucleic acid
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14920 - DNA, 34 bp, Artificial Sequence
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.
tcyatrtadccactrgcyacrtgractgctacya

SEQ ID NO: 14921 - DNA, 34 bp, Artificial Sequence; identical to SEQ ID NO: 14920
  Pan degenerate oligonucleotide primer
  primer_bind (1)..(34)
  modified_base (1)..(1): base is a locked nucleic acid
  modified_base (7)..(7): base is a locked nucleic acid
  modified_base (9)..(9): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14922 - DNA, 34 bp, Artificial Sequence; identical to SEQ ID NO: 14920
  Pan degenerate oligonucleotide primer
  primer_bind (1)..(34)
  modified_base (1)..(1): base is a locked nucleic acid
  modified_base (6)..(6): base is a locked nucleic acid
  modified_base (9)..(9): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14923 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
rtadccactrgcyacrtgractgctacya

SEQ ID NO: 14924 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
rtadccactrgcyacrtgractgctacya

SEQ ID NO: 14925 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
rtadccactrgcyacrtgractgctacya

SEQ ID NO: 14926 - DNA, 40 bp, Artificial Sequence; identical to SEQ ID NO: 14908
  Pan degenerate oligonucleotide primer
  primer_bind (1)..(40)
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14927 - DNA, 38 bp, Artificial Sequence; identical to SEQ ID NO: 14911
  Pan degenerate oligonucleotide primer
  primer_bind (1)..(38)
  misc_feature (32)..(38): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14928 - DNA, 37 bp, Artificial Sequence; identical to SEQ ID NO: 14914
  Pan degenerate oligonucleotide primer
  primer_bind (1)..(37)
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14929 - DNA, 35 bp, Artificial Sequence; identical to SEQ ID NO: 14917
  Pan degenerate oligonucleotide primer
  primer_bind (1)..(35)
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14930 - DNA, 34 bp, Artificial Sequence; identical to SEQ ID NO: 14920
  Pan degenerate oligonucleotide primer
  primer_bind (1)..(34)
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 14931 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
rtadccactrgcyacrtgractgctacya

SEQ ID NO: 14932 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 74 to correspond to the nucleotides in an oligonucleotide probe downstream of the discriminating single nucleotide polymorphism.
gctggratracytctgcttcyatrtabccactrgcyacrtgractgctac

SEQ ID NO: 14933 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tctgcttcyatrtadccactrgcyacrtgractgctacyan

SEQ ID NO: 14934 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
tgcttcyatrtadccactrgcyacrtgractgctacyan

SEQ ID NO: 14935 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
gcttcyatrtadccactrgcyacrtgractgctacyan

SEQ ID NO: 14936 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ttcyatrtadccactrgcyacrtgractgctacyan

SEQ ID NO: 14937 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tcyatrtadccactrgcyacrtgractgctacyan

SEQ ID NO: 14938 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
rtadccactrgcyacrtgractgctacyan

SEQ ID NO: 14939 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
gctggratracytctgcttcyatrtabccactrgcyacrtgractgctacn

SEQ ID NO: 14940 - DNA, 40 bp, Artificial Sequence
  Pan degenerate oligonucleotide primer
  primer_bind (1)..(40)
  modified_base (27)..(27): base is a locked nucleic acid
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (36)..(36): base is a locked nucleic acid
  modified_base (38)..(38): base is a locked nucleic acid
tgctarytttarbakrwartatgctgtytcytgycctgty

SEQ ID NO: 14941 - DNA, 40 bp, Artificial Sequence; identical to SEQ ID NO: 14940
  Pan degenerate oligonucleotide primer
  primer_bind (1)..(40)
  modified_base (27)..(27): base is a locked nucleic acid
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (38)..(38): base is a locked nucleic acid
  modified_base (39)..(39): base is a locked nucleic acid

SEQ ID NO: 14942 - DNA, 40 bp, Artificial Sequence; identical to SEQ ID NO: 14940
  Pan degenerate oligonucleotide primer
  primer_bind (1)..(40)
  modified_base (27)..(27): base is a locked nucleic acid
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (36)..(36): base is a locked nucleic acid
  modified_base (39)..(39): base is a locked nucleic acid

SEQ ID NO: 14943 - DNA, 40 bp, Artificial Sequence
  Pan degenerate oligonucleotide primer
  primer_bind (1)..(40)
  modified_base (28)..(28): base is a locked nucleic acid
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (37)..(37): base is a locked nucleic acid
  modified_base (39)..(39): base is a locked nucleic acid
gctarytttarbakrwartatgctgtytcytgycctgtyt

SEQ ID NO: 14944 - DNA, 40 bp, Artificial Sequence; identical to SEQ ID NO: 14943
  Pan degenerate oligonucleotide primer
  primer_bind (1)..(40)
  modified_base (1)..(1): base is a locked nucleic acid
  modified_base (28)..(28): base is a locked nucleic acid
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (39)..(39): base is a locked nucleic acid

SEQ ID NO: 14945 - DNA, 40 bp, Artificial Sequence; identical to SEQ ID NO: 14940
  Pan degenerate oligonucleotide primer
  primer_bind (1)..(40)
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.

SEQ ID NO: 14946 - DNA, 40 bp, Artificial Sequence; identical to SEQ ID NO: 14943
  Pan degenerate oligonucleotide primer
  primer_bind (1)..(40)
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.

SEQ ID NO: 14947 - DNA, 50 bp, Artificial Sequence
  Pan degenerate oligonucleotide primer
  primer_bind (1)..(50)
  misc_feature (24)..(24): n is a, c, g, or t
  misc_feature (44)..(50): Adaptor region of the pan degenerate antisense primer that adapts the probe-binding site downstream of codon 92 to correspond to the nucleotides in an oligonucleotide probe downstream of the discriminating single nucleotide polymorphism.
ggccayctycctgctarytttarnakrwartakgctgtytcytgycctgt

SEQ ID NO: 14948 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tgctarytttarbakrwartatgctgtytcytgycctgtyn

SEQ ID NO: 14949 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gctarytttarbakrwartatgctgtytcytgycctgtytn

SEQ ID NO: 14950 - DNA, 51 bp, Artificial Sequence
  Pan degenerate oligonucleotide primer
  primer_bind (1)..(51)
  misc_feature (24)..(24): n is a, c, g, or t
  misc_feature (44)..(50): Adaptor region of the pan degenerate antisense primer that adapts the probe-binding site downstream of codon 92 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
ggccayctycctgctarytttarnakrwartakgctgtytcytgycctgtn

SEQ ID NO: 14951 - DNA, 40 bp, Artificial Sequence
  Pan degenerate oligonucleotide primer
  primer_bind (1)..(40)
  modified_base (13)..(13): base is a locked nucleic acid
  modified_base (22)..(22): base is a locked nucleic acid
  modified_base (24)..(24): base is a locked nucleic acid
  misc_feature (34)..(40): Adaptor region of the pan degenerate antisense primer that adapts the probe-binding site downstream of codon 97 to correspond to the nucleotides in an oligonucleotide probe downstream of the discriminating single nucleotide polymorphism.
actggccaycttcctgctarytttarbakrwartatgctg

SEQ ID NO: 14952 - DNA, 40 bp, Artificial Sequence; identical to SEQ ID NO: 14951
  Pan degenerate oligonucleotide primer
  primer_bind (1)..(40)
  modified_base (1)..(1): base is a locked nucleic acid
  modified_base (13)..(13): base is a locked nucleic acid
  modified_base (24)..(24): base is a locked nucleic acid
  misc_feature (34)..(40): Adaptor region of the pan degenerate antisense primer that adapts the probe-binding site downstream of codon 97 to correspond to the nucleotides in an oligonucleotide probe downstream of the discriminating single nucleotide polymorphism.

SEQ ID NO: 14953 - DNA, 19 bp, Artificial Sequence
  Pan degenerate oligonucleotide primer
  primer_bind (1)..(19)
  modified_base (1)..(1): base is a locked nucleic acid
  modified_base (3)..(3): base is a locked nucleic acid
  modified_base (4)..(4): base is a locked nucleic acid
  misc_feature (13)..(19): Adaptor region of the pan degenerate antisense primer that adapts the probe-binding site downstream of codon 97 to correspond to the nucleotides in an oligonucleotide probe downstream of the discriminating single nucleotide polymorphism.
tttarbakrwartatgctg

SEQ ID NO: 14954 - DNA, 19 bp, Artificial Sequence
  Pan degenerate oligonucleotide primer
  primer_bind (1)..(19)
  modified_base (1)..(1): base is a locked nucleic acid
  modified_base (4)..(4): base is a locked nucleic acid
  modified_base (6)..(6): base is a locked nucleic acid
  misc_feature (13)..(19): Adaptor region of the pan degenerate antisense primer that adapts the probe-binding site downstream of codon 97 to correspond to the nucleotides in an oligonucleotide probe downstream of the discriminating single nucleotide polymorphism.
tttarbakrwartatgctg

SEQ ID NO: 14955 - DNA, 19 bp, Artificial Sequence
  Pan degenerate oligonucleotide primer
  primer_bind (1)..(19)
  modified_base (1)..(1): base is a locked nucleic acid
  modified_base (3)..(3): base is a locked nucleic acid
  modified_base (6)..(6): base is a locked nucleic acid
  misc_feature (13)..(19): Adaptor region of the pan degenerate antisense primer that adapts the probe-binding site downstream of codon 97 to correspond to the nucleotides in an oligonucleotide probe downstream of the discriminating single nucleotide polymorphism.
tttarbakrwartatgctg

SEQ ID NO: 14956 - DNA, 17 bp, Artificial Sequence
  Pan degenerate oligonucleotide primer
  primer_bind (1)..(17)
  modified_base (1)..(1): base is a locked nucleic acid
  modified_base (2)..(2): base is a locked nucleic acid
  modified_base (4)..(4): base is a locked nucleic acid
  misc_feature (11)..(17): Adaptor region of the pan degenerate antisense primer that adapts the probe-binding site downstream of codon 97 to correspond to the nucleotides in an oligonucleotide probe downstream of the discriminating single nucleotide polymorphism.
tarbakrwartatgctg

SEQ ID NO: 14957 - DNA, 17 bp, Artificial Sequence
  Pan degenerate oligonucleotide primer
  primer_bind (1)..(17)
  modified_base (1)..(1): base is a locked nucleic acid
  modified_base (4)..(4): base is a locked nucleic acid
  modified_base (10)..(10): base is a locked nucleic acid
  misc_feature (11)..(17): Adaptor region of the pan degenerate antisense primer that adapts the probe-binding site downstream of codon 97 to correspond to the nucleotides in an oligonucleotide probe downstream of the discriminating single nucleotide polymorphism.
tarbakrwartatgctg

SEQ ID NO: 14958 - DNA, 17 bp, Artificial Sequence
  Pan degenerate oligonucleotide primer
  primer_bind (1)..(17)
  modified_base (1)..(1): base is a locked nucleic acid
  modified_base (2)..(2): base is a locked nucleic acid
  modified_base (10)..(10): base is a locked nucleic acid
  misc_feature (11)..(17): Adaptor region of the pan degenerate antisense primer that adapts the probe-binding site downstream of codon 97 to correspond to the nucleotides in an oligonucleotide probe downstream of the discriminating single nucleotide polymorphism.
tarbakrwartatgctg

SEQ ID NO: 14959 - DNA, 16 bp, Artificial Sequence
  Pan degenerate oligonucleotide primer
  primer_bind (1)..(16)
  modified_base (1)..(1): base is a locked nucleic acid
  modified_base (3)..(3): base is a locked nucleic acid
  modified_base (9)..(9): base is a locked nucleic acid
  misc_feature (10)..(16): Adaptor region of the pan degenerate antisense primer that adapts the probe-binding site downstream of codon 97 to correspond to the nucleotides in an oligonucleotide probe downstream of the discriminating single nucleotide polymorphism.
arbakrwartatgctg

SEQ ID NO: 14960 - DNA, 16 bp, Artificial Sequence
  Pan degenerate oligonucleotide primer
  primer_bind (1)..(16)
  modified_base (1)..(1): base is a locked nucleic acid
  modified_base (9)..(9): base is a locked nucleic acid
  misc_feature (10)..(16): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (10)..(10): base is a locked nucleic acid
arbakrwartatgctg

SEQ ID NO: 14961 - DNA, 16 bp, Artificial Sequence
  Pan degenerate oligonucleotide primer
  primer_bind (1)..(16)
  modified_base (1)..(1): base is a locked nucleic acid
  modified_base (3)..(3): base is a locked nucleic acid
  misc_feature (10)..(16): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (10)..(10): base is a locked nucleic acid
arbakrwartatgctg

SEQ ID NO: 14962 - DNA, 14 bp, Artificial Sequence
  Pan degenerate oligonucleotide primer
  primer_bind (1)..(14)
  modified_base (1)..(1): base is a locked nucleic acid
  modified_base (7)..(7): base is a locked nucleic acid
  misc_feature (8)..(14): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (8)..(8): base is a locked nucleic acid
bakrwartatgctg

SEQ ID NO: 14963 - DNA, 14 bp, Artificial Sequence
  Pan degenerate oligonucleotide primer
  primer_bind (1)..(14)
  modified_base (1)..(1): base is a locked nucleic acid
  misc_feature (8)..(14): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (8)..(8): base is a locked nucleic acid
  modified_base (9)..(9): base is a locked nucleic acid
bakrwartatgctg

SEQ ID NO: 14964 - DNA, 14 bp, Artificial Sequence
  Pan degenerate oligonucleotide primer
  primer_bind (1)..(14)
  modified_base (1)..(1): base is a locked nucleic acid
  modified_base (7)..(7): base is a locked nucleic acid
  misc_feature (8)..(14): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (9)..(9): base is a locked nucleic acid
bakrwartatgctg

SEQ ID NO: 14965 - DNA, 40 bp, Artificial Sequence; identical to SEQ ID NO: 14951
  Pan degenerate oligonucleotide primer
  primer_bind (1)..(40)
  misc_feature (34)..(40): Adaptor region of the pan degenerate antisense primer that adapts the probe-binding site downstream of codon 97 to correspond to the nucleotides in an oligonucleotide probe downstream of the discriminating single nucleotide polymorphism.

SEQ ID NO: 14966 - DNA, 19 bp, Artificial Sequence
  Pan degenerate oligonucleotide primer
  primer_bind (1)..(19)
  misc_feature (13)..(19): Adaptor region of the pan degenerate antisense primer that adapts the probe-binding site downstream of codon 97 to correspond to the nucleotides in an oligonucleotide probe downstream of the discriminating single nucleotide polymorphism.
tttarbakrwartatgctg

SEQ ID NO: 14967 - DNA, 17 bp, Artificial Sequence
  Pan degenerate oligonucleotide primer
  primer_bind (1)..(17)
  misc_feature (11)..(17): Adaptor region of the pan degenerate antisense primer that adapts the probe-binding site downstream of codon 97 to correspond to the nucleotides in an oligonucleotide probe downstream of the discriminating single nucleotide polymorphism.
tarbakrwartatgctg

SEQ ID NO: 14968 - DNA, 16 bp, Artificial Sequence
  Pan degenerate oligonucleotide primer
  primer_bind (1)..(16)
  misc_feature (10)..(16): Adaptor region of the pan degenerate antisense primer that adapts the probe-binding site downstream of codon 97 to correspond to the nucleotides in an oligonucleotide probe downstream of the discriminating single nucleotide polymorphism.
arbakrwartatgctg

SEQ ID NO: 14969 - DNA, 14 bp, Artificial Sequence
  Pan degenerate oligonucleotide primer
  primer_bind (1)..(14)
  misc_feature (8)..(14): Adaptor region of the pan degenerate antisense primer that adapts the probe-binding site downstream of codon 97 to correspond to the nucleotides in an oligonucleotide probe downstream of the discriminating single nucleotide polymorphism.
bakrwartatgctg

SEQ ID NO: 14970 - DNA, 50 bp, Artificial Sequence
  Pan degenerate oligonucleotide primer
  primer_bind (1)..(50)
  misc_feature (39)..(39): n is a, c, g, or t
  misc_feature (44)..(50): Adaptor region of the pan degenerate antisense primer that adapts the probe-binding site downstream of codon 97 to correspond to the nucleotides in an oligonucleotide probe downstream of the discriminating single nucleotide polymorphism.
tgtaytrytytbactggccayctycctgctarytttarnakrwartatgc

SEQ ID NO: 14971 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
actggccaycttcctgctarytttarbakrwartatgctgn

SEQ ID NO: 14972 - DNA, 20 bp, Artificial Sequence
  Pan degenerate oligonucleotide primer
  primer_bind (1)..(20)
  misc_feature (13)..(19): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (20)..(20): base is a locked nucleic acid
  misc_feature (20)..(20): n is a, c, g, or t
tttarbakrwartatgctgn

SEQ ID NO: 14973 - DNA, 18 bp, Artificial Sequence
  Pan degenerate oligonucleotide primer
  primer_bind (1)..(18)
  misc_feature (11)..(17): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (18)..(18): base is a locked nucleic acid
  misc_feature (18)..(18): n is a, c, g, or t
tarbakrwartatgctgn

SEQ ID NO: 14974 - DNA, 17 bp, Artificial Sequence
  Pan degenerate oligonucleotide primer
  primer_bind (1)..(17)
  misc_feature (10)..(16): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (17)..(17): base is a locked nucleic acid
  misc_feature (17)..(17): n is a, c, g, or t
arbakrwartatgctgn

SEQ ID NO: 14975 - DNA, 15 bp, Artificial Sequence
  Pan degenerate oligonucleotide primer
  primer_bind (1)..(15)
  misc_feature (8)..(14): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (15)..(15): base is a locked nucleic acid
  misc_feature (15)..(15): n is a, c, g, or t
bakrwartatgctgn

SEQ ID NO: 14976 - DNA, 51 bp, Artificial Sequence
  Pan degenerate oligonucleotide primer
  primer_bind (1)..(51)
  misc_feature (39)..(39): n is a, c, g, or t
  misc_feature (44)..(50): Adaptor region of the pan degenerate antisense primer that adapts the probe-binding site downstream of codon 97 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
tgtaytrytytbactggccayctycctgctarytttarnakrwartatgcn

SEQ ID NO: 14977 - DNA, 40 bp, Artificial Sequence
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.
carcakgcdgcyttdacygyabyrctrgtraarttrskrc

SEQ ID NO: 14978 - DNA, 40 bp, Artificial Sequence; identical to SEQ ID NO: 14977
  Pan degenerate oligonucleotide primer
  primer_bind (1)..(40)
  modified_base (1)..(1): base is a locked nucleic acid
  modified_base (7)..(7): base is a locked nucleic acid
  modified_base (9)..(9): base is a locked nucleic acid
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14979 - DNA, 40 bp, Artificial Sequence; identical to SEQ ID NO: 14977
  Pan degenerate oligonucleotide primer
  primer_bind (1)..(40)
  modified_base (1)..(1): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14980 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 118 to correspond to the nucleotides in an oligonucleotide probe downstream of the discriminating single nucleotide polymorphism.
kgcdgcyttdacygyabyrctrgtraarttrskrc

SEQ ID NO: 14981 - DNA, 35 bp, Artificial Sequence; identical to SEQ ID NO: 14980
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14982 - DNA, 35 bp, Artificial Sequence; identical to SEQ ID NO: 14980
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14983 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.
gcdgcyttdacygyabyrctrgtraarttrskrc

SEQ ID NO: 14984 - DNA, 34 bp, Artificial Sequence; identical to SEQ ID NO: 14983
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14985 - DNA, 34 bp, Artificial Sequence; identical to SEQ ID NO: 14983
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14986 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 118 to correspond to the nucleotides in an oligonucleotide probe downstream of the discriminating single nucleotide polymorphism.
dgcyttdacygyabyrctrgtraarttrskrc

SEQ ID NO: 14987 - DNA, 32 bp, Artificial Sequence; identical to SEQ ID NO: 14986
  Pan degenerate oligonucleotide primer
  primer_bind (1)..(32)
  modified_base (1)..(1): base is a locked nucleic acid
  modified_base (4)..(4): base is a locked nucleic acid
  modified_base (8)..(8): base is a locked nucleic acid
  misc_feature (26)..(32): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14988 - DNA, 32 bp, Artificial Sequence; identical to SEQ ID NO: 14986
  Pan degenerate oligonucleotide primer
  primer_bind (1)..(32)
  modified_base (1)..(1): base is a locked nucleic acid
  modified_base (2)..(2): base is a locked nucleic acid
  modified_base (8)..(8): base is a locked nucleic acid
  misc_feature (26)..(32): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14989 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (7)..(7): base is a locked nucleic acid
  misc_feature (25)..(31): Adaptor region of the pan degenerate antisense primer that adapts the probe-binding site downstream of codon 118 to correspond to the nucleotides in an oligonucleotide probe downstream of the discriminating single nucleotide polymorphism.
gcyttdacygyabyrctrgtraarttrskrc

SEQ ID NO: 14990 - DNA, 31 bp, Artificial Sequence; identical to SEQ ID NO: 14989
  Pan degenerate oligonucleotide primer
  primer_bind (1)..(31)
  modified_base (1)..(1): base is a locked nucleic acid
  modified_base (7)..(7): base is a locked nucleic acid
  modified_base (21)..(21): base is a locked nucleic acid
  misc_feature (25)..(31): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14991 - DNA, 31 bp, Artificial Sequence; identical to SEQ ID NO: 14989
  Pan degenerate oligonucleotide primer
  primer_bind (1)..(31)
  modified_base (1)..(1): base is a locked nucleic acid
  modified_base (3)..(3): base is a locked nucleic acid
  modified_base (21)..(21): base is a locked nucleic acid
  misc_feature (25)..(31): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14992 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (19)..(19): base is a locked nucleic acid
  misc_feature (23)..(29): Adaptor region of the pan degenerate antisense primer that adapts the probe-binding site downstream of codon 118 to correspond to the nucleotides in an oligonucleotide probe downstream of the discriminating single nucleotide polymorphism.
yttdacygyabyrctrgtraarttrskrc

SEQ ID NO: 14993 - DNA, 29 bp, Artificial Sequence
  Pan degenerate oligonucleotide primer
  primer_bind (1)..(29)
  modified_base (1)..(1): base is a locked nucleic acid
  modified_base (19)..(19): base is a locked nucleic acid
  modified_base (20)..(20): base is a locked nucleic acid
  misc_feature (23)..(29): Adaptor region of the pan degenerate antisense primer that adapts the probe-binding site downstream of codon 118 to correspond to the nucleotides in an oligonucleotide probe downstream of the discriminating single nucleotide polymorphism.
yttdacygyabyrctrgtraarttrskrc

SEQ ID NO: 14994 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (20)..(20): base is a locked nucleic acid
  misc_feature (23)..(29): Adaptor region of the pan degenerate antisense primer that adapts the probe-binding site downstream of codon 118 to correspond to the nucleotides in an oligonucleotide probe downstream of the discriminating single nucleotide polymorphism.
yttdacygyabyrctrgtraarttrskrc

SEQ ID NO: 14995 - DNA, 40 bp, Artificial Sequence; identical to SEQ ID NO: 14977
  Pan degenerate oligonucleotide primer
  primer_bind (1)..(40)
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14996 - DNA, 35 bp, Artificial Sequence; identical to SEQ ID NO: 14980
  Pan degenerate oligonucleotide primer
  primer_bind (1)..(35)
  misc_feature (29)..(35): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14997 - DNA, 34 bp, Artificial Sequence; identical to SEQ ID NO: 14983
  Pan degenerate oligonucleotide primer
  primer_bind (1)..(34)
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14998 - DNA, 32 bp, Artificial Sequence; identical to SEQ ID NO: 14986
  Pan degenerate oligonucleotide primer
  primer_bind (1)..(32)
  misc_feature (26)..(32): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 14999 - DNA, 31 bp, Artificial Sequence; identical to SEQ ID NO: 14989
  Pan degenerate oligonucleotide primer
  primer_bind (1)..(31)
  misc_feature (25)..(31): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 15000 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 118 to correspond to the nucleotides in an oligonucleotide probe downstream of the discriminating single nucleotide polymorphism.
yttdacygyabyrctrgtraarttrskrc

SEQ ID NO: 15001 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 118 to correspond to the nucleotides in an oligonucleotide probe downstream of the discriminating single nucleotide polymorphism.
ayhyybgcccaccarcakgcdgcyttdacygyrkyrctrrtraarttgct

SEQ ID NO: 15002 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
carcakgcdgcyttdacygyabyrctrgtraarttrskrcn

SEQ ID NO: 15003 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
kgcdgcyttdacygyabyrctrgtraarttrskrcn

SEQ ID NO: 15004 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
gcdgcyttdacygyabyrctrgtraarttrskrcn

SEQ ID NO: 15005 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
dgcyttdacygyabyrctrgtraarttrskrcn

SEQ ID NO: 15006 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
gcyttdacygyabyrctrgtraarttrskrcn

SEQ ID NO: 15007 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
yttdacygyabyrctrgtraarttrskrcn

SEQ ID NO: 15008 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
ayhyybgcccaccarcakgcdgcyttdacygyrkyrctrrtraarttgctn

SEQ ID NO: 15009 - DNA, 40 bp, Artificial Sequence
  Pan degenerate oligonucleotide primer
  primer_bind (1)..(40)
  modified_base (2)..(2): base is a locked nucleic acid
  modified_base (6)..(6): base is a locked nucleic acid
  modified_base (20)..(20): base is a locked nucleic acid
  misc_feature (34)..(40): Adaptor region of the pan degenerate antisense primer that adapts the probe-binding site downstream of codon 121 to correspond to the nucleotides in an oligonucleotide probe downstream of the discriminating single nucleotide polymorphism.
vyybgcccaccarcakgcdgcyttdacygyabyrctrgtr

SEQ ID NO: 15010 - DNA, 40 bp, Artificial Sequence; identical to SEQ ID NO: 15009
  Pan degenerate oligonucleotide primer
  primer_bind (1)..(40)
  modified_base (2)..(2): base is a locked nucleic acid
  modified_base (20)..(20): base is a locked nucleic acid
  modified_base (21)..(21): base is a locked nucleic acid
  misc_feature (34)..(40): Adaptor region of the pan degenerate antisense primer that adapts the probe-binding site downstream of codon 121 to correspond to the nucleotides in an oligonucleotide probe downstream of the discriminating single nucleotide polymorphism.

SEQ ID NO: 15011 - DNA, 40 bp, Artificial Sequence; identical to SEQ ID NO: 15009
  Pan degenerate oligonucleotide primer
  primer_bind (1)..(40)
  modified_base (2)..(2): base is a locked nucleic acid
  modified_base (6)..(6): base is a locked nucleic acid
  modified_base (21)..(21): base is a locked nucleic acid
  misc_feature (34)..(40): Adaptor region of the pan degenerate antisense primer that adapts the probe-binding site downstream of codon 121 to correspond to the nucleotides in an oligonucleotide probe downstream of the discriminating single nucleotide polymorphism.

SEQ ID NO: 15012 - DNA, 35 bp, Artificial Sequence
  Pan degenerate oligonucleotide primer
  primer_bind (1)..(35)
  modified_base (1)..(1): base is a locked nucleic acid
  modified_base (15)..(15): base is a locked nucleic acid
  modified_base (16)..(16): base is a locked nucleic acid
  misc_feature (29)..(35): Adaptor region of the pan degenerate antisense primer that adapts the probe-binding site downstream of codon 121 to correspond to the nucleotides in an oligonucleotide probe downstream of the discriminating single nucleotide polymorphism.
cccaccarcakgcdgcyttdacygyabyrctrgtr

SEQ ID NO: 15013 - DNA, 35 bp, Artificial Sequence; identical to SEQ ID NO: 15012
  Pan degenerate oligonucleotide primer
  primer_bind (1)..(35)
  modified_base (1)..(1): base is a locked nucleic acid
  modified_base (16)..(16): base is a locked nucleic acid
  modified_base (18)..(18): base is a locked nucleic acid
  misc_feature (29)..(35): Adaptor region of the pan degenerate antisense primer that adapts the probe-binding site downstream of codon 121 to correspond to the nucleotides in an oligonucleotide probe downstream of the discriminating single nucleotide polymorphism.

SEQ ID NO: 15014 - DNA, 35 bp, Artificial Sequence; identical to SEQ ID NO: 15012
  Pan degenerate oligonucleotide primer
  primer_bind (1)..(35)
  modified_base (1)..(1): base is a locked nucleic acid
  modified_base (15)..(15): base is a locked nucleic acid
  modified_base (18)..(18): base is a locked nucleic acid
  misc_feature (29)..(35): Adaptor region of the pan degenerate antisense primer that adapts the probe-binding site downstream of codon 121 to correspond to the nucleotides in an oligonucleotide probe downstream of the discriminating single nucleotide polymorphism.

SEQ ID NO: 15015 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (4)..(4): base is a locked nucleic acid
  misc_feature (15)..(21): Adaptor region of the pan degenerate antisense primer that adapts the probe-binding site downstream of codon 121 to correspond to the nucleotides in an oligonucleotide probe downstream of the discriminating single nucleotide polymorphism.
gcyttdacygyabyrctrgtr

SEQ ID NO: 15016 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (5)..(5): base is a locked nucleic acid
  misc_feature (15)..(21): Adaptor region of the pan degenerate antisense primer that adapts the probe-binding site downstream of codon 121 to correspond to the nucleotides in an oligonucleotide probe downstream of the discriminating single nucleotide polymorphism.
gcyttdacygyabyrctrgtr

SEQ ID NO: 15017 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (5)..(5): base is a locked nucleic acid
  misc_feature (15)..(21): Adaptor region of the pan degenerate antisense primer that adapts the probe-binding site downstream of codon 121 to correspond to the nucleotides in an oligonucleotide probe downstream of the discriminating single nucleotide polymorphism.
gcyttdacygyabyrctrgtr

SEQ ID NO: 15018 - DNA, 20 bp, Artificial Sequence
  Pan degenerate oligonucleotide primer
  primer_bind (1)..(20)
  modified_base (1)..(1): base is a locked nucleic acid
  modified_base (3)..(3): base is a locked nucleic acid
  modified_base (4)..(4): base is a locked nucleic acid
  misc_feature (14)..(20): Adaptor region of the pan degenerate antisense primer that adapts the probe-binding site downstream of codon 121 to correspond to the nucleotides in an oligonucleotide probe downstream of the discriminating single nucleotide polymorphism.
cyttdacygyabyrctrgtr

SEQ ID NO: 15019 - DNA, 20 bp, Artificial Sequence
  Pan degenerate oligonucleotide primer
  primer_bind (1)..(20)
  modified_base (1)..(1): base is a locked nucleic acid
  modified_base (4)..(4): base is a locked nucleic acid
  modified_base (6)..(6): base is a locked nucleic acid
  misc_feature (14)..(20): Adaptor region of the pan degenerate antisense primer that adapts the probe-binding site downstream of codon 121 to correspond to the nucleotides in an oligonucleotide probe downstream of the discriminating single nucleotide polymorphism.
cyttdacygyabyrctrgtr

SEQ ID NO: 15020 - DNA, 20 bp, Artificial Sequence
  Pan degenerate oligonucleotide primer
  primer_bind (1)..(20)
  modified_base (1)..(1): base is a locked nucleic acid
  modified_base (3)..(3): base is a locked nucleic acid
  modified_base (6)..(6): base is a locked nucleic acid
  misc_feature (14)..(20): Adaptor region of the pan degenerate antisense primer that adapts the probe-binding site downstream of codon 121 to correspond to the nucleotides in an oligonucleotide probe downstream of the discriminating single nucleotide polymorphism.
cyttdacygyabyrctrgtr

SEQ ID NO: 15021 - DNA, 18 bp, Artificial Sequence
  Pan degenerate oligonucleotide primer
  primer_bind (1)..(18)
  modified_base (1)..(1): base is a locked nucleic acid
  modified_base (2)..(2): base is a locked nucleic acid
  modified_base (4)..(4): base is a locked nucleic acid
  misc_feature (12)..(18): Adaptor region of the pan degenerate antisense primer that adapts the probe-binding site downstream of codon 121 to correspond to the nucleotides in an oligonucleotide probe downstream of the discriminating single nucleotide polymorphism.
ttdacygyabyrctrgtr

SEQ ID NO: 15022 - DNA, 18 bp, Artificial Sequence
  Pan degenerate oligonucleotide primer
  primer_bind (1)..(18)
  modified_base (1)..(1): base is a locked nucleic acid
  modified_base (4)..(4): base is a locked nucleic acid
  modified_base (5)..(5): base is a locked nucleic acid
  misc_feature (12)..(18): Adaptor region of the pan degenerate antisense primer that adapts the probe-binding site downstream of codon 121 to correspond to the nucleotides in an oligonucleotide probe downstream of the discriminating single nucleotide polymorphism.
ttdacygyabyrctrgtr

SEQ ID NO: 15023 - DNA, 18 bp, Artificial Sequence
  Pan degenerate oligonucleotide primer
  primer_bind (1)..(18)
  modified_base (1)..(1): base is a locked nucleic acid
  modified_base (2)..(2): base is a locked nucleic acid
  modified_base (5)..(5): base is a locked nucleic acid
  misc_feature (12)..(18): Adaptor region of the pan degenerate antisense primer that adapts the probe-binding site downstream of codon 121 to correspond to the nucleotides in an oligonucleotide probe downstream of the discriminating single nucleotide polymorphism.
ttdacygyabyrctrgtr

SEQ ID NO: 15024 - DNA, 17 bp, Artificial Sequence
  Pan degenerate oligonucleotide primer
  primer_bind (1)..(17)
  modified_base (1)..(1): base is a locked nucleic acid
  modified_base (3)..(3): base is a locked nucleic acid
  modified_base (4)..(4): base is a locked nucleic acid
  misc_feature (11)..(17): Adaptor region of the pan degenerate antisense primer that adapts the probe-binding site downstream of codon 121 to correspond to the nucleotides in an oligonucleotide probe downstream of the discriminating single nucleotide polymorphism.
tdacygyabyrctrgtr

SEQ ID NO: 15025 - DNA, 17 bp, Artificial Sequence
  Pan degenerate oligonucleotide primer
  primer_bind (1)..(17)
  modified_base (1)..(1): base is a locked nucleic acid
  modified_base (4)..(4): base is a locked nucleic acid
  modified_base (6)..(6): base is a locked nucleic acid
  misc_feature (11)..(17): Adaptor region of the pan degenerate antisense primer that adapts the probe-binding site downstream of codon 121 to correspond to the nucleotides in an oligonucleotide probe downstream of the discriminating single nucleotide polymorphism.
tdacygyabyrctrgtr

SEQ ID NO: 15026 - DNA, 17 bp, Artificial Sequence
  Pan degenerate oligonucleotide primer
  primer_bind (1)..(17)
  modified_base (1)..(1): base is a locked nucleic acid
  modified_base (3)..(3): base is a locked nucleic acid
  modified_base (6)..(6): base is a locked nucleic acid
  misc_feature (11)..(17): Adaptor region of the pan degenerate antisense primer that adapts the probe-binding site downstream of codon 121 to correspond to the nucleotides in an oligonucleotide probe downstream of the discriminating single nucleotide polymorphism.
tdacygyabyrctrgtr

SEQ ID NO: 15027 - DNA, 40 bp, Artificial Sequence; identical to SEQ ID NO: 15009
  Pan degenerate oligonucleotide primer
  primer_bind (1)..(40)
  misc_feature (34)..(40): Adaptor region of the pan degenerate antisense primer that adapts the probe-binding site downstream of codon 121 to correspond to the nucleotides in an oligonucleotide probe downstream of the discriminating single nucleotide polymorphism.

SEQ ID NO: 15028 - DNA, 35 bp, Artificial Sequence; identical to SEQ ID NO: 15012
  Pan degenerate oligonucleotide primer
  primer_bind (1)..(35)
  misc_feature (29)..(35): Adaptor region of the pan degenerate antisense primer that adapts the probe-binding site downstream of codon 121 to correspond to the nucleotides in an oligonucleotide probe downstream of the discriminating single nucleotide polymorphism.

SEQ ID NO: 15029 - DNA, 21 bp, Artificial Sequence
  Pan degenerate oligonucleotide primer
  primer_bind (1)..(21)
  misc_feature (15)..(21): Adaptor region of the pan degenerate antisense primer that adapts the probe-binding site downstream of codon 121 to correspond to the nucleotides in an oligonucleotide probe downstream of the discriminating single nucleotide polymorphism.
gcyttdacygyabyrctrgtr

SEQ ID NO: 15030 - DNA, 20 bp, Artificial Sequence
  Pan degenerate oligonucleotide primer
  primer_bind (1)..(20)
  misc_feature (14)..(20): Adaptor region of the pan degenerate antisense primer that adapts the probe-binding site downstream of codon 121 to correspond to the nucleotides in an oligonucleotide probe downstream of the discriminating single nucleotide polymorphism.
cyttdacygyabyrctrgtr

SEQ ID NO: 15031 - DNA, 18 bp, Artificial Sequence
  Pan degenerate oligonucleotide primer
  primer_bind (1)..(18)
  misc_feature (12)..(18): Adaptor region of the pan degenerate antisense primer that adapts the probe-binding site downstream of codon 121 to correspond to the nucleotides in an oligonucleotide probe downstream of the discriminating single nucleotide polymorphism.
ttdacygyabyrctrgtr

SEQ ID NO: 15032 - DNA, 17 bp, Artificial Sequence
  Pan degenerate oligonucleotide primer
  primer_bind (1)..(17)
  misc_feature (11)..(17): Adaptor region of the pan degenerate antisense primer that adapts the probe-binding site downstream of codon 121 to correspond to the nucleotides in an oligonucleotide probe downstream of the discriminating single nucleotide polymorphism.
tdacygyabyrctrgtr

SEQ ID NO: 15033 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 121 to correspond to the nucleotides in an oligonucleotide probe downstream of the discriminating single nucleotide polymorphism.
ytcytgybkrayhyybgcccaccarcakgcdgcyttdacygyrkyactggt

SEQ ID NO: 15034 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 121 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
vyybgcccaccarcakgcdgcyttdacygyabyrctrgtrn

SEQ ID NO: 15035 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 121 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
cccaccarcakgcdgcyttdacygyabyrctrgtrn

SEQ ID NO: 15036 - DNA, 22 bp, Artificial Sequence
  Pan degenerate oligonucleotide primer
  primer_bind (1)..(22)
  misc_feature (15)..(21): Adaptor region of the pan degenerate antisense primer that adapts the probe-binding site downstream of codon 121 to correspond to the nucleotides in an oligonucleotide probe downstream of the discriminating single nucleotide polymorphism.
  modified_base (22)..(22): base is a locked nucleic acid
  misc_feature (22)..(22): n is a, c, g, or t
gcyttdacygyabyrctrgtrn

SEQ ID NO: 15037 - DNA, 21 bp, Artificial Sequence
  Pan degenerate oligonucleotide primer
  primer_bind (1)..(21)
  misc_feature (14)..(20): Adaptor region of the pan degenerate antisense primer that adapts the probe-binding site downstream of codon 121 to correspond to the nucleotides in an oligonucleotide probe downstream of the discriminating single nucleotide polymorphism.
  modified_base (21)..(21): base is a locked nucleic acid
  misc_feature (21)..(21): n is a, c, g, or t
cyttdacygyabyrctrgtrn

SEQ ID NO: 15038 - DNA, 19 bp, Artificial Sequence
  Pan degenerate oligonucleotide primer
  primer_bind (1)..(19)
  misc_feature (12)..(18): Adaptor region of the pan degenerate antisense primer that adapts the probe-binding site downstream of codon 121 to correspond to the nucleotides in an oligonucleotide probe downstream of the discriminating single nucleotide polymorphism.
  modified_base (19)..(19): base is a locked nucleic acid
  misc_feature (19)..(19): n is a, c, g, or t
ttdacygyabyrctrgtrn

SEQ ID NO: 15039 - DNA, 18 bp, Artificial Sequence
  Pan degenerate oligonucleotide primer
  primer_bind (1)..(18)
  misc_feature (11)..(17): Adaptor region of the pan degenerate antisense primer that adapts the probe-binding site downstream of codon 121 to correspond to the nucleotides in an oligonucleotide probe downstream of the discriminating single nucleotide polymorphism.
  modified_base (18)..(18): base is a locked nucleic acid
  misc_feature (18)..(18): n is a, c, g, or t
tdacygyabyrctrgtrn

SEQ ID NO: 15040 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 121 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ytcytgybkrayhyybgcccaccarcakgcdgcyttdacygyrkyactggtn

SEQ ID NO: 15041 - DNA, 40 bp, Artificial Sequence
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
yactactccytgrctttggggattgtagggratbccaaat

SEQ ID NO: 15042 - DNA, 40 bp, Artificial Sequence; identical to SEQ ID NO: 15041
  Pan degenerate oligonucleotide primer
  primer_bind (1)..(40)
  modified_base (2)..(2): base is a locked nucleic acid
  modified_base (9)..(9): base is a locked nucleic acid
  modified_base (11)..(11): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15043 - DNA, 40 bp, Artificial Sequence; identical to SEQ ID NO: 15041
  Pan degenerate oligonucleotide primer
  primer_bind (1)..(40)
  modified_base (2)..(2): base is a locked nucleic acid
  modified_base (6)..(6): base is a locked nucleic acid
  modified_base (11)..(11): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15044 - DNA, 35 bp, Artificial Sequence
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.
ctccytgrctttggggattgtagggratbccaaat

SEQ ID NO: 15045 - DNA, 35 bp, Artificial Sequence; identical to SEQ ID NO: 15044
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15046 - DNA, 35 bp, Artificial Sequence; identical to SEQ ID NO: 15044
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15047 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.
cytgrctttggggattgtagggratbccaaat

SEQ ID NO: 15048 - DNA, 32 bp, Artificial Sequence; identical to SEQ ID NO: 15047
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15049 - DNA, 32 bp, Artificial Sequence; identical to SEQ ID NO: 15047
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15050 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate antisense primer that adapts the probe-binding site downstream of codon 138 to correspond to the nucleotides in an oligonucleotide probe downstream of the discriminating single nucleotide polymorphism.
tgrctttggggattgtagggratbccaaat

SEQ ID NO: 15051 - DNA, 30 bp, Artificial Sequence; identical to SEQ ID NO: 15050
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15052 - DNA, 30 bp, Artificial Sequence; identical to SEQ ID NO: 15050
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15053 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
grctttggggattgtagggratbccaaat

SEQ ID NO: 15054 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
grctttggggattgtagggratbccaaat

SEQ ID NO: 15055 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
grctttggggattgtagggratbccaaat

SEQ ID NO: 15056 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (4)..(4): base is a locked nucleic acid
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaat

SEQ ID NO: 15057 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaat

SEQ ID NO: 15058 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaat

SEQ ID NO: 15059 - DNA, 40 bp, Artificial Sequence
  Pan degenerate oligonucleotide primer
  primer_bind (1)..(40)
  modified_base (3)..(3): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
actactccytgrctttggggattgtagggratbccaaatt

SEQ ID NO: 15060 - DNA, 40 bp, Artificial Sequence; identical to SEQ ID NO: 15059
  Pan degenerate oligonucleotide primer
  primer_bind (1)..(40)
  modified_base (3)..(3): base is a locked nucleic acid
  modified_base (10)..(10): base is a locked nucleic acid
  modified_base (12)..(12): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15061 - DNA, 40 bp, Artificial Sequence; identical to SEQ ID NO: 15059
  Pan degenerate oligonucleotide primer
  primer_bind (1)..(40)
  modified_base (3)..(3): base is a locked nucleic acid
  modified_base (7)..(7): base is a locked nucleic acid
  modified_base (12)..(12): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15062 - DNA, 34 bp, Artificial Sequence
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.
ccytgrctttggggattgtagggratbccaaatt

SEQ ID NO: 15063 - DNA, 34 bp, Artificial Sequence; identical to SEQ ID NO: 15062
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15064 - DNA, 34 bp, Artificial Sequence; identical to SEQ ID NO: 15062
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15065 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.
tgrctttggggattgtagggratbccaaatt

SEQ ID NO: 15066 - DNA, 31 bp, Artificial Sequence; identical to SEQ ID NO: 15065
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15067 - DNA, 31 bp, Artificial Sequence; identical to SEQ ID NO: 15065
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15068 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
rctttggggattgtagggratbccaaatt

SEQ ID NO: 15069 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
rctttggggattgtagggratbccaaatt

SEQ ID NO: 15070 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
rctttggggattgtagggratbccaaatt

SEQ ID NO: 15071 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaatt

SEQ ID NO: 15072 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaatt

SEQ ID NO: 15073 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (6)..(6): base is a locked nucleic acid
  misc_feature (22)..(28): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaatt

SEQ ID NO: 15074 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (4)..(4): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
ttggggattgtagggratbccaaatt

SEQ ID NO: 15075 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (5)..(5): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
ttggggattgtagggratbccaaatt

SEQ ID NO: 15076 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (5)..(5): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
ttggggattgtagggratbccaaatt

SEQ ID NO: 15077 - DNA, 40 bp, Artificial Sequence; identical to SEQ ID NO: 15041
  Pan degenerate oligonucleotide primer
  primer_bind (1)..(40)
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15078 - DNA, 35 bp, Artificial Sequence; identical to SEQ ID NO: 15044
  Pan degenerate oligonucleotide primer
  primer_bind (1)..(35)
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15079 - DNA, 32 bp, Artificial Sequence; identical to SEQ ID NO: 15047
  Pan degenerate oligonucleotide primer
  primer_bind (1)..(32)
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15080 - DNA, 30 bp, Artificial Sequence; identical to SEQ ID NO: 15050
  Pan degenerate oligonucleotide primer
  primer_bind (1)..(30)
  misc_feature (24)..(30): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15081 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
grctttggggattgtagggratbccaaat

SEQ ID NO: 15082 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaat

SEQ ID NO: 15083 - DNA, 40 bp, Artificial Sequence; identical to SEQ ID NO: 15059
  Pan degenerate oligonucleotide primer
  primer_bind (1)..(40)
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15084 - DNA, 34 bp, Artificial Sequence; identical to SEQ ID NO: 15062
  Pan degenerate oligonucleotide primer
  primer_bind (1)..(34)
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15085 - DNA, 31 bp, Artificial Sequence; identical to SEQ ID NO: 15065
  Pan degenerate oligonucleotide primer
  primer_bind (1)..(31)
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 15086 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
rctttggggattgtagggratbccaaatt

SEQ ID NO: 15087 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 138 to correspond to the nucleotides in an oligonucleotide probe downstream of the discriminating single nucleotide polymorphism.
ctttggggattgtagggratbccaaatt

SEQ ID NO: 15088 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
ttggggattgtagggratbccaaatt

SEQ ID NO: 15089 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 138 to correspond to the nucleotides in an oligonucleotide probe downstream of the discriminating single nucleotide polymorphism.
attcatrgaytcyactactccytgrctttgrggattgtagggrattccaaa

SEQ ID NO: 15090 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yactactccytgrctttggggattgtagggratbccaaatn

SEQ ID NO: 15091 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ctccytgrctttggggattgtagggratbccaaatn

SEQ ID NO: 15092 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
cytgrctttggggattgtagggratbccaaatn

SEQ ID NO: 15093 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tgrctttggggattgtagggratbccaaatn

SEQ ID NO: 15094 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
grctttggggattgtagggratbccaaatn

SEQ ID NO: 15095 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
ctttggggattgtagggratbccaaatn

SEQ ID NO: 15096 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
actactccytgrctttggggattgtagggratbccaaattn

SEQ ID NO: 15097 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ccytgrctttggggattgtagggratbccaaattn

SEQ ID NO: 15098 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
tgrctttggggattgtagggratbccaaattn

SEQ ID NO: 15099 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
rctttggggattgtagggratbccaaattn

SEQ ID NO: 15100 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
ctttggggattgtagggratbccaaattn

SEQ ID NO: 15101 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
ttggggattgtagggratbccaaattn

SEQ ID NO: 15102 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
attcatrgaytcyactactccytgrctttgrggattgtagggrattccaaan

SEQ ID NO: 15103 - DNA, 40 bp, Artificial Sequence
  Pan degenerate oligonucleotide primer
  primer_bind (1)..(40)
  modified_base (3)..(3): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.
rgaytcyactactccytgrctttggggattgtagggratb

SEQ ID NO: 15104 - DNA, 40 bp, Artificial Sequence; identical to SEQ ID NO: 15103
  Pan degenerate oligonucleotide primer
  primer_bind (1)..(40)
  modified_base (3)..(3): base is a locked nucleic acid
  modified_base (6)..(6): base is a locked nucleic acid
  modified_base (8)..(8): base is a locked nucleic acid
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15105 - DNA, 40 bp, Artificial Sequence; identical to SEQ ID NO: 15103
  Pan degenerate oligonucleotide primer
  primer_bind (1)..(40)
  modified_base (3)..(3): base is a locked nucleic acid
  modified_base (5)..(5): base is a locked nucleic acid
  modified_base (8)..(8): base is a locked nucleic acid
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15106 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate antisense primer that adapts the probe-binding site downstream of codon 140 to correspond to the nucleotides in an oligonucleotide probe downstream of the discriminating single nucleotide polymorphism.
tcyactactccytgrctttggggattgtagggratb

SEQ ID NO: 15107 - DNA, 36 bp, Artificial Sequence; identical to SEQ ID NO: 15106
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15108 - DNA, 36 bp, Artificial Sequence; identical to SEQ ID NO: 15106
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15109 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.
cyactactccytgrctttggggattgtagggratb

SEQ ID NO: 15110 - DNA, 35 bp, Artificial Sequence; identical to SEQ ID NO: 15109
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15111 - DNA, 35 bp, Artificial Sequence; identical to SEQ ID NO: 15109
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15112 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 140 to correspond to the nucleotides in an oligonucleotide probe downstream of the discriminating single nucleotide polymorphism.
actactccytgrctttggggattgtagggratb

SEQ ID NO: 15113 - DNA, 33 bp, Artificial Sequence; identical to SEQ ID NO: 15112
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15114 - DNA, 33 bp, Artificial Sequence; identical to SEQ ID NO: 15112
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15115 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.
ctactccytgrctttggggattgtagggratb

SEQ ID NO: 15116 - DNA, 32 bp, Artificial Sequence; identical to SEQ ID NO: 15115
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15117 - DNA, 32 bp, Artificial Sequence; identical to SEQ ID NO: 15115
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15118 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate antisense primer that adapts the probe-binding site downstream of codon 140 to correspond to the nucleotides in an oligonucleotide probe downstream of the discriminating single nucleotide polymorphism.
actccytgrctttggggattgtagggratb

SEQ ID NO: 15119 - DNA, 30 bp, Artificial Sequence; identical to SEQ ID NO: 15118
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15120 - DNA, 30 bp, Artificial Sequence; identical to SEQ ID NO: 15118
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15121 - DNA, 40 bp, Artificial Sequence
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.
gaytcyactactccytgrctttggggattgtagggratbc

SEQ ID NO: 15122 - DNA, 40 bp, Artificial Sequence; identical to SEQ ID NO: 15121
  Pan degenerate oligonucleotide primer
  primer_bind (1)..(40)
  modified_base (6)..(6): base is a locked nucleic acid
  modified_base (7)..(7): base is a locked nucleic acid
  modified_base (9)..(9): base is a locked nucleic acid
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15123 - DNA, 40 bp, Artificial Sequence; identical to SEQ ID NO: 15121
  Pan degenerate oligonucleotide primer
  primer_bind (1)..(40)
  modified_base (4)..(4): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15124 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 140 to correspond to the nucleotides in an oligonucleotide probe downstream of the discriminating single nucleotide polymorphism.
tcyactactccytgrctttggggattgtagggratbc

SEQ ID NO: 15125 - DNA, 37 bp, Artificial Sequence; identical to SEQ ID NO: 15124
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15126 - DNA, 37 bp, Artificial Sequence; identical to SEQ ID NO: 15124
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15127 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.
yactactccytgrctttggggattgtagggratbc

SEQ ID NO: 15128 - DNA, 35 bp, Artificial Sequence; identical to SEQ ID NO: 15127
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15129 - DNA, 35 bp, Artificial Sequence; identical to SEQ ID NO: 15127
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15130 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 140 to correspond to the nucleotides in an oligonucleotide probe downstream of the discriminating single nucleotide polymorphism.
actactccytgrctttggggattgtagggratbc

SEQ ID NO: 15131 - DNA, 34 bp, Artificial Sequence; identical to SEQ ID NO: 15130
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15132 - DNA, 34 bp, Artificial Sequence; identical to SEQ ID NO: 15130
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15133 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.
tactccytgrctttggggattgtagggratbc

SEQ ID NO: 15134 - DNA, 32 bp, Artificial Sequence; identical to SEQ ID NO: 15133
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15135 - DNA, 32 bp, Artificial Sequence; identical to SEQ ID NO: 15133
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15136 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 140 to correspond to the nucleotides in an oligonucleotide probe downstream of the discriminating single nucleotide polymorphism.
actccytgrctttggggattgtagggratbc

SEQ ID NO: 15137 - DNA, 31 bp, Artificial Sequence; identical to SEQ ID NO: 15136
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15138 - DNA, 31 bp, Artificial Sequence; identical to SEQ ID NO: 15136
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (25)..(31): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15139 - DNA, 40 bp, Artificial Sequence; identical to SEQ ID NO: 15103
  Pan degenerate oligonucleotide primer
  primer_bind (1)..(40)
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15140 - DNA, 36 bp, Artificial Sequence; identical to SEQ ID NO: 15106
  Pan degenerate oligonucleotide primer
  primer_bind (1)..(36)
  misc_feature (30)..(36): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15141 - DNA, 35 bp, Artificial Sequence; identical to SEQ ID NO: 15109
  Pan degenerate oligonucleotide primer
  primer_bind (1)..(35)
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15142 - DNA, 33 bp, Artificial Sequence; identical to SEQ ID NO: 15112
  Pan degenerate oligonucleotide primer
  primer_bind (1)..(33)
  misc_feature (27)..(33): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15143 - DNA, 32 bp, Artificial Sequence; identical to SEQ ID NO: 15115
  Pan degenerate oligonucleotide primer
  primer_bind (1)..(32)
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15144 - DNA, 30 bp, Artificial Sequence; identical to SEQ ID NO: 15118
  Pan degenerate oligonucleotide primer
  primer_bind (1)..(30)
  misc_feature (24)..(30): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15145 - DNA, 40 bp, Artificial Sequence; identical to SEQ ID NO: 15121
  Pan degenerate oligonucleotide primer
  primer_bind (1)..(40)
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15146 - DNA, 37 bp, Artificial Sequence; identical to SEQ ID NO: 15124
  Pan degenerate oligonucleotide primer
  primer_bind (1)..(37)
  misc_feature (31)..(37): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15147 - DNA, 35 bp, Artificial Sequence; identical to SEQ ID NO: 15127
  Pan degenerate oligonucleotide primer
  primer_bind (1)..(35)
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15148 - DNA, 34 bp, Artificial Sequence; identical to SEQ ID NO: 15130
  Pan degenerate oligonucleotide primer
  primer_bind (1)..(34)
  misc_feature (28)..(34): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15149 - DNA, 32 bp, Artificial Sequence; identical to SEQ ID NO: 15133
  Pan degenerate oligonucleotide primer
  primer_bind (1)..(32)
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15150 - DNA, 31 bp, Artificial Sequence; identical to SEQ ID NO: 15136
  Pan degenerate oligonucleotide primer
  primer_bind (1)..(31)
  misc_feature (25)..(31): Adaptor region of the pan degenerate antisense primer that adapts the probe-binding site downstream of codon 140 to correspond to the nucleotides in an oligonucleotide probe downstream of the discriminating single nucleotide polymorphism.

SEQ ID NO: 15151 - DNA, 52 bp, Artificial Sequence
  Pan degenerate oligonucleotide primer
  primer_bind (1)..(52)
  misc_feature (46)..(52): Adaptor region of the pan degenerate antisense primer that adapts the probe-binding site downstream of codon 140 to correspond to the nucleotides in an oligonucleotide probe downstream of the discriminating single nucleotide polymorphism.
aytchttattcatrgaytcyactactccytgrctttgrggattgtagggaat

SEQ ID NO: 15152 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
rgaytcyactactccytgrctttggggattgtagggratbn

SEQ ID NO: 15153 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
tcyactactccytgrctttggggattgtagggratbn

SEQ ID NO: 15154 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
cyactactccytgrctttggggattgtagggratbn

SEQ ID NO: 15155 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
actactccytgrctttggggattgtagggratbn

SEQ ID NO: 15156 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ctactccytgrctttggggattgtagggratbn

SEQ ID NO: 15157 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
actccytgrctttggggattgtagggratbn

SEQ ID NO: 15158 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gaytcyactactccytgrctttggggattgtagggratbcn

SEQ ID NO: 15159 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
tcyactactccytgrctttggggattgtagggratbcn

SEQ ID NO: 15160 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
yactactccytgrctttggggattgtagggratbcn

SEQ ID NO: 15161 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
actactccytgrctttggggattgtagggratbcn

SEQ ID NO: 15162 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tactccytgrctttggggattgtagggratbcn

SEQ ID NO: 15163 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
actccytgrctttggggattgtagggratbcn

SEQ ID NO: 15164 - DNA, 53 bp, Artificial Sequence
  Pan degenerate oligonucleotide primer
  primer_bind (1)..(53)
  misc_feature (46)..(52): Adaptor region of the pan degenerate antisense primer that adapts the probe-binding site downstream of codon 140 to correspond to the nucleotides in an oligonucleotide probe downstream of the discriminating single nucleotide polymorphism.
  modified_base (53)..(53): base is a locked nucleic acid
  misc_feature (53)..(53): n is a, c, g, or t
aytchttattcatrgaytcyactactccytgrctttgrggattgtagggaatn

SEQ ID NO: 15165 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.
yttattcatrgaytcyactactccytgrctttggggattg

SEQ ID NO: 15166 - DNA, 40 bp, Artificial Sequence; identical to SEQ ID NO: 15165
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15167 - DNA, 40 bp, Artificial Sequence; identical to SEQ ID NO: 15165
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15168 - DNA, 38 bp, Artificial Sequence
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.
tattcatrgaytcyactactccytgrctttggggattg

SEQ ID NO: 15169 - DNA, 38 bp, Artificial Sequence; identical to SEQ ID NO: 15168
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15170 - DNA, 38 bp, Artificial Sequence; identical to SEQ ID NO: 15168
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15171 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate antisense primer that adapts the probe-binding site downstream of codon 143 to correspond to the nucleotides in an oligonucleotide probe downstream of the discriminating single nucleotide polymorphism.
ttcatrgaytcyactactccytgrctttggggattg

SEQ ID NO: 15172 - DNA, 36 bp, Artificial Sequence; identical to SEQ ID NO: 15171
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15173 - DNA, 36 bp, Artificial Sequence; identical to SEQ ID NO: 15171
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15174 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.
tcatrgaytcyactactccytgrctttggggattg

SEQ ID NO: 15175 - DNA, 35 bp, Artificial Sequence; identical to SEQ ID NO: 15174
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15176 - DNA, 35 bp, Artificial Sequence; identical to SEQ ID NO: 15174
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15177 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 143 to correspond to the nucleotides in an oligonucleotide probe downstream of the discriminating single nucleotide polymorphism.
atrgaytcyactactccytgrctttggggattg

SEQ ID NO: 15178 - DNA, 33 bp, Artificial Sequence; identical to SEQ ID NO: 15177
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15179 - DNA, 33 bp, Artificial Sequence; identical to SEQ ID NO: 15177
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15180 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.
trgaytcyactactccytgrctttggggattg

SEQ ID NO: 15181 - DNA, 32 bp, Artificial Sequence; identical to SEQ ID NO: 15180
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15182 - DNA, 32 bp, Artificial Sequence; identical to SEQ ID NO: 15180
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15183 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.
ttattcatrgaytcyactactccytgrctttggggattgt

SEQ ID NO: 15184 - DNA, 40 bp, Artificial Sequence; identical to SEQ ID NO: 15183
  Pan degenerate oligonucleotide primer
  primer_bind (1)..(40)
  modified_base (4)..(4): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15185 - DNA, 40 bp, Artificial Sequence; identical to SEQ ID NO: 15183
  Pan degenerate oligonucleotide primer
  primer_bind (1)..(40)
  modified_base (3)..(3): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15186 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.
attcatrgaytcyactactccytgrctttggggattgt

SEQ ID NO: 15187 - DNA, 38 bp, Artificial Sequence; identical to SEQ ID NO: 15186
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15188 - DNA, 38 bp, Artificial Sequence; identical to SEQ ID NO: 15186
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15189 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 143 to correspond to the nucleotides in an oligonucleotide probe downstream of the discriminating single nucleotide polymorphism.
ttcatrgaytcyactactccytgrctttggggattgt

SEQ ID NO: 15190 - DNA, 37 bp, Artificial Sequence; identical to SEQ ID NO: 15189
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15191 - DNA, 37 bp, Artificial Sequence; identical to SEQ ID NO: 15189
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15192 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.
catrgaytcyactactccytgrctttggggattgt

SEQ ID NO: 15193 - DNA, 35 bp, Artificial Sequence; identical to SEQ ID NO: 15192
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15194 - DNA, 35 bp, Artificial Sequence; identical to SEQ ID NO: 15192
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15195 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 143 to correspond to the nucleotides in an oligonucleotide probe downstream of the discriminating single nucleotide polymorphism.
atrgaytcyactactccytgrctttggggattgt

SEQ ID NO: 15196 - DNA, 34 bp, Artificial Sequence; identical to SEQ ID NO: 15195
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15197 - DNA, 34 bp, Artificial Sequence; identical to SEQ ID NO: 15195
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15198 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.
rgaytcyactactccytgrctttggggattgt

SEQ ID NO: 15199 - DNA, 32 bp, Artificial Sequence; identical to SEQ ID NO: 15198
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15200 - DNA, 32 bp, Artificial Sequence; identical to SEQ ID NO: 15198
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15201 - DNA, 40 bp, Artificial Sequence; identical to SEQ ID NO: 15165
  Pan degenerate oligonucleotide primer
  primer_bind (1)..(40)
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15202 - DNA, 38 bp, Artificial Sequence; identical to SEQ ID NO: 15168
  Pan degenerate oligonucleotide primer
  primer_bind (1)..(38)
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15203 - DNA, 36 bp, Artificial Sequence; identical to SEQ ID NO: 15171
  Pan degenerate oligonucleotide primer
  primer_bind (1)..(36)
  misc_feature (30)..(36): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15204 - DNA, 35 bp, Artificial Sequence; identical to SEQ ID NO: 15174
  Pan degenerate oligonucleotide primer
  primer_bind (1)..(35)
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15205 - DNA, 33 bp, Artificial Sequence; identical to SEQ ID NO: 15177
  Pan degenerate oligonucleotide primer
  primer_bind (1)..(33)
  misc_feature (27)..(33): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15206 - DNA, 32 bp, Artificial Sequence; identical to SEQ ID NO: 15180
  Pan degenerate oligonucleotide primer
  primer_bind (1)..(32)
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15207 - DNA, 40 bp, Artificial Sequence; identical to SEQ ID NO: 15183
  Pan degenerate oligonucleotide primer
  primer_bind (1)..(40)
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15208 - DNA, 38 bp, Artificial Sequence; identical to SEQ ID NO: 15186
  Pan degenerate oligonucleotide primer
  primer_bind (1)..(38)
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15209 - DNA, 37 bp, Artificial Sequence; identical to SEQ ID NO: 15189
  Pan degenerate oligonucleotide primer
  primer_bind (1)..(37)
  misc_feature (31)..(37): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15210 - DNA, 35 bp, Artificial Sequence; identical to SEQ ID NO: 15192
  Pan degenerate oligonucleotide primer
  primer_bind (1)..(35)
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15211 - DNA, 34 bp, Artificial Sequence; identical to SEQ ID NO: 15195
  Pan degenerate oligonucleotide primer
  primer_bind (1)..(34)
  misc_feature (28)..(34): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15212 - DNA, 32 bp, Artificial Sequence; identical to SEQ ID NO: 15198
  Pan degenerate oligonucleotide primer
  primer_bind (1)..(32)
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.

SEQ ID NO: 15213 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 143 to correspond to the nucleotides in an oligonucleotide probe downstream of the discriminating single nucleotide polymorphism.
yttctttaaytchttattcatrgaytcyactactccytgrctttggggatt

SEQ ID NO: 15214 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yttattcatrgaytcyactactccytgrctttggggattgn

SEQ ID NO: 15215 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
tattcatrgaytcyactactccytgrctttggggattgn

SEQ ID NO: 15216 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
ttcatrgaytcyactactccytgrctttggggattgn

SEQ ID NO: 15217 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
tcatrgaytcyactactccytgrctttggggattgn

SEQ ID NO: 15218 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
atrgaytcyactactccytgrctttggggattgn

SEQ ID NO: 15219 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
trgaytcyactactccytgrctttggggattgn

SEQ ID NO: 15220 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ttattcatrgaytcyactactccytgrctttggggattgtn

SEQ ID NO: 15221 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
attcatrgaytcyactactccytgrctttggggattgtn

SEQ ID NO: 15222 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ttcatrgaytcyactactccytgrctttggggattgtn

SEQ ID NO: 15223 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
catrgaytcyactactccytgrctttggggattgtn

SEQ ID NO: 15224 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
atrgaytcyactactccytgrctttggggattgtn

SEQ ID NO: 15225 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
rgaytcyactactccytgrctttggggattgtn

SEQ ID NO: 15226 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 143 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
yttctttaaytchttattcatrgaytcyactactccytgrctttggggattn

SEQ ID NO: 15227 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 145 to correspond to the nucleotides in an oligonucleotide probe downstream of the discriminating single nucleotide polymorphism.
aaytcyttattcatrgaytcyactactccytgrctttggg

SEQ ID NO: 15228 - DNA, 40 bp, Artificial Sequence; identical to SEQ ID NO: 15227
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15229 - DNA, 40 bp, Artificial Sequence; identical to SEQ ID NO: 15227
  Pan degenerate oligonucleotide primer
  primer_bind (1)..(40)
  modified_base (1)..(1): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15230 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 145 to correspond to the nucleotides in an oligonucleotide probe downstream of the discriminating single nucleotide polymorphism.
ytcyttattcatrgaytcyactactccytgrctttggg

SEQ ID NO: 15231 - DNA, 38 bp, Artificial Sequence; identical to SEQ ID NO: 15230
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15232 - DNA, 38 bp, Artificial Sequence; identical to SEQ ID NO: 15230
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15233 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 145 to correspond to the nucleotides in an oligonucleotide probe downstream of the discriminating single nucleotide polymorphism.
tcyttattcatrgaytcyactactccytgrctttggg

SEQ ID NO: 15234 - DNA, 37 bp, Artificial Sequence; identical to SEQ ID NO: 15233
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15235 - DNA, 37 bp, Artificial Sequence; identical to SEQ ID NO: 15233
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15236 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 145 to correspond to the nucleotides in an oligonucleotide probe downstream of the discriminating single nucleotide polymorphism.
yttattcatrgaytcyactactccytgrctttggg

SEQ ID NO: 15237 - DNA, 35 bp, Artificial Sequence; identical to SEQ ID NO: 15236
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15238 - DNA, 35 bp, Artificial Sequence; identical to SEQ ID NO: 15236
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15239 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 145 to correspond to the nucleotides in an oligonucleotide probe downstream of the discriminating single nucleotide polymorphism.
ttattcatrgaytcyactactccytgrctttggg

SEQ ID NO: 15240 - DNA, 34 bp, Artificial Sequence; identical to SEQ ID NO: 15239
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15241 - DNA, 34 bp, Artificial Sequence; identical to SEQ ID NO: 15239
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15242 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 145 to correspond to the nucleotides in an oligonucleotide probe downstream of the discriminating single nucleotide polymorphism.
attcatrgaytcyactactccytgrctttggg

SEQ ID NO: 15243 - DNA, 32 bp, Artificial Sequence; identical to SEQ ID NO: 15242
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15244 - DNA, 32 bp, Artificial Sequence; identical to SEQ ID NO: 15242
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15245 - DNA, 40 bp, Artificial Sequence; identical to SEQ ID NO: 15227
  Pan degenerate oligonucleotide primer
  primer_bind (1)..(40)
  misc_feature (34)..(40): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15246 - DNA, 38 bp, Artificial Sequence; identical to SEQ ID NO: 15230
  Pan degenerate oligonucleotide primer
  primer_bind (1)..(38)
  misc_feature (32)..(38): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15247 - DNA, 37 bp, Artificial Sequence; identical to SEQ ID NO: 15233
  Pan degenerate oligonucleotide primer
  primer_bind (1)..(37)
  misc_feature (31)..(37): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15248 - DNA, 35 bp, Artificial Sequence; identical to SEQ ID NO: 15236
  Pan degenerate oligonucleotide primer
  primer_bind (1)..(35)
  misc_feature (29)..(35): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15249 - DNA, 34 bp, Artificial Sequence; identical to SEQ ID NO: 15239
  Pan degenerate oligonucleotide primer
  primer_bind (1)..(34)
  misc_feature (28)..(34): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15250 - DNA, 32 bp, Artificial Sequence; identical to SEQ ID NO: 15242
  Pan degenerate oligonucleotide primer
  primer_bind (1)..(32)
  misc_feature (26)..(32): Adaptor region of the pan degenerate antisense primer that adapts the probe-binding site downstream of codon 145 to correspond to the nucleotides in an oligonucleotide probe downstream of the discriminating single nucleotide polymorphism.

SEQ ID NO: 15251 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 145 to correspond to the nucleotides in an oligonucleotide probe downstream of the discriminating single nucleotide polymorphism.
tatratyttctttaaytchttattcatrgaytcyactactccytgactttg

SEQ ID NO: 15252 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 145 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
aaytcyttattcatrgaytcyactactccytgrctttgggn

SEQ ID NO: 15253 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 145 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ytcyttattcatrgaytcyactactccytgrctttgggn

SEQ ID NO: 15254 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 145 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
tcyttattcatrgaytcyactactccytgrctttgggn

SEQ ID NO: 15255 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 145 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
yttattcatrgaytcyactactccytgrctttgggn

SEQ ID NO: 15256 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 145 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ttattcatrgaytcyactactccytgrctttgggn

SEQ ID NO: 15257 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 145 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
attcatrgaytcyactactccytgrctttgggn

SEQ ID NO: 15258 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 145 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tatratyttctttaaytchttattcatrgaytcyactactccytgactttgn

SEQ ID NO: 15259 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 146 to correspond to the nucleotides in an oligonucleotide probe downstream of the discriminating single nucleotide polymorphism.
ctttaaytcyttattcatrgaytcyactactccytgrctt

SEQ ID NO: 15260 - DNA, 40 bp, Artificial Sequence; identical to SEQ ID NO: 15259
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15261 - DNA, 40 bp, Artificial Sequence; identical to SEQ ID NO: 15259
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15262 - DNA, 38 bp, Artificial Sequence
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 146 to correspond to the nucleotides in an oligonucleotide probe downstream of the discriminating single nucleotide polymorphism.
ttaaytcyttattcatrgaytcyactactccytgrctt

SEQ ID NO: 15263 - DNA, 38 bp, Artificial Sequence; identical to SEQ ID NO: 15262
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15264 - DNA, 38 bp, Artificial Sequence; identical to SEQ ID NO: 15262
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15265 - DNA, 36 bp, Artificial Sequence
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate antisense primer that adapts the probe-binding site downstream of codon 146 to correspond to the nucleotides in an oligonucleotide probe downstream of the discriminating single nucleotide polymorphism.
aaytcyttattcatrgaytcyactactccytgrctt

SEQ ID NO: 15266 - DNA, 36 bp, Artificial Sequence; identical to SEQ ID NO: 15265
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15267 - DNA, 36 bp, Artificial Sequence; identical to SEQ ID NO: 15265
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15268 - DNA, 35 bp, Artificial Sequence
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 146 to correspond to the nucleotides in an oligonucleotide probe downstream of the discriminating single nucleotide polymorphism.
aytcyttattcatrgaytcyactactccytgrctt

SEQ ID NO: 15269 - DNA, 35 bp, Artificial Sequence; identical to SEQ ID NO: 15268
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15270 - DNA, 35 bp, Artificial Sequence; identical to SEQ ID NO: 15268
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15271 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 146 to correspond to the nucleotides in an oligonucleotide probe downstream of the discriminating single nucleotide polymorphism.
tcyttattcatrgaytcyactactccytgrctt

SEQ ID NO: 15272 - DNA, 33 bp, Artificial Sequence; identical to SEQ ID NO: 15271
  Pan degenerate oligonucleotide primer
  primer_bind (1)..(33)
  modified_base (1)..(1): base is a locked nucleic acid
  modified_base (4)..(4): base is a locked nucleic acid
  modified_base (11)..(11): base is a locked nucleic acid
  misc_feature (27)..(33): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15273 - DNA, 33 bp, Artificial Sequence; identical to SEQ ID NO: 15271
  Pan degenerate oligonucleotide primer
  primer_bind (1)..(33)
  modified_base (1)..(1): base is a locked nucleic acid
  modified_base (2)..(2): base is a locked nucleic acid
  modified_base (11)..(11): base is a locked nucleic acid
  misc_feature (27)..(33): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15274 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (10)..(10): base is a locked nucleic acid
  misc_feature (26)..(32): Adaptor region of the pan degenerate antisense primer that adapts the probe-binding site downstream of codon 146 to correspond to the nucleotides in an oligonucleotide probe downstream of the discriminating single nucleotide polymorphism.
cyttattcatrgaytcyactactccytgrctt

SEQ ID NO: 15275 - DNA, 32 bp, Artificial Sequence; identical to SEQ ID NO: 15274
  Pan degenerate oligonucleotide primer
  primer_bind (1)..(32)
  modified_base (1)..(1): base is a locked nucleic acid
  modified_base (10)..(10): base is a locked nucleic acid
  modified_base (19)..(19): base is a locked nucleic acid
  misc_feature (26)..(32): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15276 - DNA, 32 bp, Artificial Sequence; identical to SEQ ID NO: 15274
  Pan degenerate oligonucleotide primer
  primer_bind (1)..(32)
  modified_base (1)..(1): base is a locked nucleic acid
  modified_base (3)..(3): base is a locked nucleic acid
  modified_base (19)..(19): base is a locked nucleic acid
  misc_feature (26)..(32): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15277 - DNA, 40 bp, Artificial Sequence; identical to SEQ ID NO: 15259
  Pan degenerate oligonucleotide primer
  primer_bind (1)..(40)
  misc_feature (34)..(40): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15278 - DNA, 38 bp, Artificial Sequence; identical to SEQ ID NO: 15262
  Pan degenerate oligonucleotide primer
  primer_bind (1)..(38)
  misc_feature (32)..(38): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15279 - DNA, 36 bp, Artificial Sequence; identical to SEQ ID NO: 15265
  Pan degenerate oligonucleotide primer
  primer_bind (1)..(36)
  misc_feature (30)..(36): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15280 - DNA, 35 bp, Artificial Sequence; identical to SEQ ID NO: 15268
  Pan degenerate oligonucleotide primer
  primer_bind (1)..(35)
  misc_feature (29)..(35): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15281 - DNA, 33 bp, Artificial Sequence; identical to SEQ ID NO: 15271
  Pan degenerate oligonucleotide primer
  primer_bind (1)..(33)
  misc_feature (27)..(33): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15282 - DNA, 32 bp, Artificial Sequence; identical to SEQ ID NO: 15274
  Pan degenerate oligonucleotide primer
  primer_bind (1)..(32)
  misc_feature (26)..(32): Adaptor region of the pan degenerate antisense primer that adapts the probe-binding site downstream of codon 146 to correspond to the nucleotides in an oligonucleotide probe downstream of the discriminating single nucleotide polymorphism.

SEQ ID NO: 15283 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 146 to correspond to the nucleotides in an oligonucleotide probe downstream of the discriminating single nucleotide polymorphism.
yyctatratyttctttaaytchttattcatrgaytcyactactccttgact

SEQ ID NO: 15284 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 146 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ctttaaytcyttattcatrgaytcyactactccytgrcttn

SEQ ID NO: 15285 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 146 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ttaaytcyttattcatrgaytcyactactccytgrcttn

SEQ ID NO: 15286 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 146 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
aaytcyttattcatrgaytcyactactccytgrcttn

SEQ ID NO: 15287 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 146 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
aytcyttattcatrgaytcyactactccytgrcttn

SEQ ID NO: 15288 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 146 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tcyttattcatrgaytcyactactccytgrcttn

SEQ ID NO: 15289 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 146 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
cyttattcatrgaytcyactactccytgrcttn

SEQ ID NO: 15290 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 146 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
yyctatratyttctttaaytchttattcatrgaytcyactactccttgactn

SEQ ID NO: 15291 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 147 to correspond to the nucleotides in an oligonucleotide probe downstream of the discriminating single nucleotide polymorphism.
ttctttaaytcyttattcatrgaytcyactactccytgrc

SEQ ID NO: 15292 - DNA, 40 bp, Artificial Sequence; identical to SEQ ID NO: 15291
  Pan degenerate oligonucleotide primer
  primer_bind (1)..(40)
  modified_base (4)..(4): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15293 - DNA, 40 bp, Artificial Sequence; identical to SEQ ID NO: 15291
  Pan degenerate oligonucleotide primer
  primer_bind (1)..(40)
  modified_base (3)..(3): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15294 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 147 to correspond to the nucleotides in an oligonucleotide probe downstream of the discriminating single nucleotide polymorphism.
ctttaaytcyttattcatrgaytcyactactccytgrc

SEQ ID NO: 15295 - DNA, 38 bp, Artificial Sequence; identical to SEQ ID NO: 15294
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15296 - DNA, 38 bp, Artificial Sequence; identical to SEQ ID NO: 15294
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15297 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 147 to correspond to the nucleotides in an oligonucleotide probe downstream of the discriminating single nucleotide polymorphism.
tttaaytcyttattcatrgaytcyactactccytgrc

SEQ ID NO: 15298 - DNA, 37 bp, Artificial Sequence; identical to SEQ ID NO: 15297
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15299 - DNA, 37 bp, Artificial Sequence; identical to SEQ ID NO: 15297
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15300 - DNA, 35 bp, Artificial Sequence
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 147 to correspond to the nucleotides in an oligonucleotide probe downstream of the discriminating single nucleotide polymorphism.
taaytcyttattcatrgaytcyactactccytgrc

SEQ ID NO: 15301 - DNA, 35 bp, Artificial Sequence; identical to SEQ ID NO: 15300
  Pan degenerate oligonucleotide primer
  primer_bind (1)..(35)
  modified_base (1)..(1): base is a locked nucleic acid
  modified_base (4)..(4): base is a locked nucleic acid
  modified_base (11)..(11): base is a locked nucleic acid
  misc_feature (29)..(35): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15302 - DNA, 35 bp, Artificial Sequence; identical to SEQ ID NO: 15300
  Pan degenerate oligonucleotide primer
  primer_bind (1)..(35)
  modified_base (1)..(1): base is a locked nucleic acid
  modified_base (2)..(2): base is a locked nucleic acid
  modified_base (11)..(11): base is a locked nucleic acid
  misc_feature (29)..(35): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15303 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (10)..(10): base is a locked nucleic acid
  misc_feature (28)..(34): Adaptor region of the pan degenerate antisense primer that adapts the probe-binding site downstream of codon 147 to correspond to the nucleotides in an oligonucleotide probe downstream of the discriminating single nucleotide polymorphism.
aaytcyttattcatrgaytcyactactccytgrc

SEQ ID NO: 15304 - DNA, 34 bp, Artificial Sequence; identical to SEQ ID NO: 15303
  Pan degenerate oligonucleotide primer
  primer_bind (1)..(34)
  modified_base (1)..(1): base is a locked nucleic acid
  modified_base (10)..(10): base is a locked nucleic acid
  modified_base (19)..(19): base is a locked nucleic acid
  misc_feature (28)..(34): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15305 - DNA, 34 bp, Artificial Sequence; identical to SEQ ID NO: 15303
  Pan degenerate oligonucleotide primer
  primer_bind (1)..(34)
  modified_base (1)..(1): base is a locked nucleic acid
  modified_base (3)..(3): base is a locked nucleic acid
  modified_base (19)..(19): base is a locked nucleic acid
  misc_feature (28)..(34): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15306 - DNA, 32 bp, Artificial Sequence
  Pan degenerate oligonucleotide primer
  primer_bind (1)..(32)
  modified_base (1)..(1): base is a locked nucleic acid
  modified_base (8)..(8): base is a locked nucleic acid
  modified_base (17)..(17): base is a locked nucleic acid
  misc_feature (26)..(32): Adaptor region of the pan degenerate antisense primer that adapts the probe-binding site downstream of codon 147 to correspond to the nucleotides in an oligonucleotide probe downstream of the discriminating single nucleotide polymorphism.
ytcyttattcatrgaytcyactactccytgrc

SEQ ID NO: 15307 - DNA, 32 bp, Artificial Sequence; identical to SEQ ID NO: 15306
  Pan degenerate oligonucleotide primer
  primer_bind (1)..(32)
  modified_base (1)..(1): base is a locked nucleic acid
  modified_base (17)..(17): base is a locked nucleic acid
  misc_feature (26)..(32): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (26)..(26): base is a locked nucleic acid

SEQ ID NO: 15308 - DNA, 32 bp, Artificial Sequence; identical to SEQ ID NO: 15306
  Pan degenerate oligonucleotide primer
  primer_bind (1)..(32)
  modified_base (1)..(1): base is a locked nucleic acid
  modified_base (8)..(8): base is a locked nucleic acid
  misc_feature (26)..(32): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (26)..(26): base is a locked nucleic acid

SEQ ID NO: 15309 - DNA, 40 bp, Artificial Sequence; identical to SEQ ID NO: 15291
  Pan degenerate oligonucleotide primer
  primer_bind (1)..(40)
  misc_feature (34)..(40): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15310 - DNA, 38 bp, Artificial Sequence; identical to SEQ ID NO: 15294
  Pan degenerate oligonucleotide primer
  primer_bind (1)..(38)
  misc_feature (32)..(38): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15311 - DNA, 37 bp, Artificial Sequence; identical to SEQ ID NO: 15297
  Pan degenerate oligonucleotide primer
  primer_bind (1)..(37)
  misc_feature (31)..(37): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15312 - DNA, 35 bp, Artificial Sequence; identical to SEQ ID NO: 15300
  Pan degenerate oligonucleotide primer
  primer_bind (1)..(35)
  misc_feature (29)..(35): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15313 - DNA, 34 bp, Artificial Sequence; identical to SEQ ID NO: 15303
  Pan degenerate oligonucleotide primer
  primer_bind (1)..(34)
  misc_feature (28)..(34): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15314 - DNA, 32 bp, Artificial Sequence; identical to SEQ ID NO: 15306
  Pan degenerate oligonucleotide primer
  primer_bind (1)..(32)
  misc_feature (26)..(32): Adaptor region of the pan degenerate antisense primer that adapts the probe-binding site downstream of codon 147 to correspond to the nucleotides in an oligonucleotide probe downstream of the discriminating single nucleotide polymorphism.

SEQ ID NO: 15315 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 147 to correspond to the nucleotides in an oligonucleotide probe downstream of the discriminating single nucleotide polymorphism.
tgyyctatratyttctttaaytchttattcatrgaytcyactactccttg

SEQ ID NO: 15316 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ttctttaaytcyttattcatrgaytcyactactccytgrcn

SEQ ID NO: 15317 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ctttaaytcyttattcatrgaytcyactactccytgrcn

SEQ ID NO: 15318 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
tttaaytcyttattcatrgaytcyactactccytgrcn

SEQ ID NO: 15319 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
taaytcyttattcatrgaytcyactactccytgrcn

SEQ ID NO: 15320 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
aaytcyttattcatrgaytcyactactccytgrcn

SEQ ID NO: 15321 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ytcyttattcatrgaytcyactactccytgrcn

SEQ ID NO: 15322 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 147 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
tgyyctatratyttctttaaytchttattcatrgaytcyactactccttgn

SEQ ID NO: 15323 - DNA, 40 bp, Artificial Sequence
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.
trattttctttaaytcyttattcatrgaytcyactactcc

SEQ ID NO: 15324 - DNA, 40 bp, Artificial Sequence; identical to SEQ ID NO: 15323
  Pan degenerate oligonucleotide primer
  primer_bind (1)..(40)
  modified_base (4)..(4): base is a locked nucleic acid
  modified_base (11)..(11): base is a locked nucleic acid
  modified_base (20)..(20): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15325 - DNA, 40 bp, Artificial Sequence; identical to SEQ ID NO: 15323
  Pan degenerate oligonucleotide primer
  primer_bind (1)..(40)
  modified_base (2)..(2): base is a locked nucleic acid
  modified_base (4)..(4): base is a locked nucleic acid
  modified_base (20)..(20): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15326 - DNA, 39 bp, Artificial Sequence
  Pan degenerate oligonucleotide primer
  primer_bind (1)..(39)
  modified_base (1)..(1): base is a locked nucleic acid
  modified_base (3)..(3): base is a locked nucleic acid
  modified_base (10)..(10): base is a locked nucleic acid
  misc_feature (33)..(39): Adaptor region of the pan degenerate antisense primer that adapts the probe-binding site downstream of codon 148 to correspond to the nucleotides in an oligonucleotide probe downstream of the discriminating single nucleotide polymorphism.
rattttctttaaytcyttattcatrgaytcyactactcc

SEQ ID NO: 15327 - DNA, 39 bp, Artificial Sequence; identical to SEQ ID NO: 15326
  Pan degenerate oligonucleotide primer
  primer_bind (1)..(39)
  modified_base (1)..(1): base is a locked nucleic acid
  modified_base (10)..(10): base is a locked nucleic acid
  modified_base (19)..(19): base is a locked nucleic acid
  misc_feature (33)..(39): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15328 - DNA, 39 bp, Artificial Sequence; identical to SEQ ID NO: 15326
  Pan degenerate oligonucleotide primer
  primer_bind (1)..(39)
  modified_base (1)..(1): base is a locked nucleic acid
  modified_base (3)..(3): base is a locked nucleic acid
  modified_base (19)..(19): base is a locked nucleic acid
  misc_feature (33)..(39): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15329 - DNA, 37 bp, Artificial Sequence
  Pan degenerate oligonucleotide primer
  primer_bind (1)..(37)
  modified_base (1)..(1): base is a locked nucleic acid
  modified_base (8)..(8): base is a locked nucleic acid
  modified_base (17)..(17): base is a locked nucleic acid
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.
ttttctttaaytcyttattcatrgaytcyactactcc

SEQ ID NO: 15330 - DNA, 37 bp, Artificial Sequence; identical to SEQ ID NO: 15329
  Pan degenerate oligonucleotide primer
  primer_bind (1)..(37)
  modified_base (1)..(1): base is a locked nucleic acid
  modified_base (17)..(17): base is a locked nucleic acid
  modified_base (26)..(26): base is a locked nucleic acid
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15331 - DNA, 37 bp, Artificial Sequence; identical to SEQ ID NO: 15329
  Pan degenerate oligonucleotide primer
  primer_bind (1)..(37)
  modified_base (1)..(1): base is a locked nucleic acid
  modified_base (8)..(8): base is a locked nucleic acid
  modified_base (26)..(26): base is a locked nucleic acid
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15332 - DNA, 30 bp, Artificial Sequence
  Pan degenerate oligonucleotide primer
  primer_bind (1)..(30)
  modified_base (1)..(1): base is a locked nucleic acid
  modified_base (10)..(10): base is a locked nucleic acid
  modified_base (19)..(19): base is a locked nucleic acid
  misc_feature (24)..(30): Adaptor region of the pan degenerate antisense primer that adapts the probe-binding site downstream of codon 148 to correspond to the nucleotides in an oligonucleotide probe downstream of the discriminating single nucleotide polymorphism.
taaytcyttattcatrgaytcyactactcc

SEQ ID NO: 15333 - DNA, 30 bp, Artificial Sequence; identical to SEQ ID NO: 15332
  Pan degenerate oligonucleotide primer
  primer_bind (1)..(30)
  modified_base (1)..(1): base is a locked nucleic acid
  modified_base (19)..(19): base is a locked nucleic acid
  modified_base (21)..(21): base is a locked nucleic acid
  misc_feature (24)..(30): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15334 - DNA, 30 bp, Artificial Sequence; identical to SEQ ID NO: 15332
  Pan degenerate oligonucleotide primer
  primer_bind (1)..(30)
  modified_base (1)..(1): base is a locked nucleic acid
  modified_base (10)..(10): base is a locked nucleic acid
  modified_base (21)..(21): base is a locked nucleic acid
  misc_feature (24)..(30): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15335 - DNA, 21 bp, Artificial Sequence
  Pan degenerate oligonucleotide primer
  primer_bind (1)..(21)
  modified_base (1)..(1): base is a locked nucleic acid
  modified_base (10)..(10): base is a locked nucleic acid
  modified_base (12)..(12): base is a locked nucleic acid
  misc_feature (15)..(21): Adaptor region of the pan degenerate antisense primer that adapts the probe-binding site downstream of codon 148 to correspond to the nucleotides in an oligonucleotide probe downstream of the discriminating single nucleotide polymorphism.
attcatrgaytcyactactcc

SEQ ID NO: 15336 - DNA, 21 bp, Artificial Sequence
  Pan degenerate oligonucleotide primer
  primer_bind (1)..(21)
  modified_base (1)..(1): base is a locked nucleic acid
  modified_base (12)..(12): base is a locked nucleic acid
  misc_feature (15)..(21): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (19)..(19): base is a locked nucleic acid
attcatrgaytcyactactcc

SEQ ID NO: 15337 - DNA, 21 bp, Artificial Sequence
  Pan degenerate oligonucleotide primer
  primer_bind (1)..(21)
  modified_base (1)..(1): base is a locked nucleic acid
  modified_base (10)..(10): base is a locked nucleic acid
  misc_feature (15)..(21): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (19)..(19): base is a locked nucleic acid
attcatrgaytcyactactcc

SEQ ID NO: 15338 - DNA, 40 bp, Artificial Sequence
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.
attttctttaaytcyttattcatrgaytcyactactccyt

SEQ ID NO: 15339 - DNA, 40 bp, Artificial Sequence; identical to SEQ ID NO: 15338
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15340 - DNA, 40 bp, Artificial Sequence; identical to SEQ ID NO: 15338
  Pan degenerate oligonucleotide primer
  primer_bind (1)..(40)
  modified_base (1)..(1): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15341 - DNA, 38 bp, Artificial Sequence
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.
tttctttaaytcyttattcatrgaytcyactactccyt

SEQ ID NO: 15342 - DNA, 38 bp, Artificial Sequence; identical to SEQ ID NO: 15341
  Pan degenerate oligonucleotide primer
  primer_bind (1)..(38)
  modified_base (1)..(1): base is a locked nucleic acid
  modified_base (4)..(4): base is a locked nucleic acid
  modified_base (11)..(11): base is a locked nucleic acid
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15343 - DNA, 38 bp, Artificial Sequence; identical to SEQ ID NO: 15341
  Pan degenerate oligonucleotide primer
  primer_bind (1)..(38)
  modified_base (1)..(1): base is a locked nucleic acid
  modified_base (2)..(2): base is a locked nucleic acid
  modified_base (11)..(11): base is a locked nucleic acid
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15344 - DNA, 37 bp, Artificial Sequence
  Pan degenerate oligonucleotide primer
  primer_bind (1)..(37)
  modified_base (1)..(1): base is a locked nucleic acid
  modified_base (3)..(3): base is a locked nucleic acid
  modified_base (10)..(10): base is a locked nucleic acid
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.
ttctttaaytcyttattcatrgaytcyactactccyt

SEQ ID NO: 15345 - DNA, 37 bp, Artificial Sequence; identical to SEQ ID NO: 15344
  Pan degenerate oligonucleotide primer
  primer_bind (1)..(37)
  modified_base (1)..(1): base is a locked nucleic acid
  modified_base (10)..(10): base is a locked nucleic acid
  modified_base (19)..(19): base is a locked nucleic acid
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15346 - DNA, 37 bp, Artificial Sequence; identical to SEQ ID NO: 15344
  Pan degenerate oligonucleotide primer
  primer_bind (1)..(37)
  modified_base (1)..(1): base is a locked nucleic acid
  modified_base (3)..(3): base is a locked nucleic acid
  modified_base (19)..(19): base is a locked nucleic acid
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15347 - DNA, 35 bp, Artificial Sequence
  Pan degenerate oligonucleotide primer
  primer_bind (1)..(35)
  modified_base (1)..(1): base is a locked nucleic acid
  modified_base (8)..(8): base is a locked nucleic acid
  modified_base (17)..(17): base is a locked nucleic acid
  misc_feature (29)..(35): Adaptor region of the pan degenerate antisense primer that adapts the probe-binding site downstream of codon 148 to correspond to the nucleotides in an oligonucleotide probe downstream of the discriminating single nucleotide polymorphism.
ctttaaytcyttattcatrgaytcyactactccyt

SEQ ID NO: 15348 - DNA, 35 bp, Artificial Sequence; identical to SEQ ID NO: 15347
  Pan degenerate oligonucleotide primer
  primer_bind (1)..(35)
  modified_base (1)..(1): base is a locked nucleic acid
  modified_base (17)..(17): base is a locked nucleic acid
  modified_base (26)..(26): base is a locked nucleic acid
  misc_feature (29)..(35): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15349 - DNA, 35 bp, Artificial Sequence; identical to SEQ ID NO: 15347
  Pan degenerate oligonucleotide primer
  primer_bind (1)..(35)
  modified_base (1)..(1): base is a locked nucleic acid
  modified_base (8)..(8): base is a locked nucleic acid
  modified_base (26)..(26): base is a locked nucleic acid
  misc_feature (29)..(35): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15350 - DNA, 28 bp, Artificial Sequence
  Pan degenerate oligonucleotide primer
  primer_bind (1)..(28)
  modified_base (1)..(1): base is a locked nucleic acid
  modified_base (10)..(10): base is a locked nucleic acid
  modified_base (19)..(19): base is a locked nucleic acid
  misc_feature (22)..(28): Adaptor region of the pan degenerate antisense primer that adapts the probe-binding site downstream of codon 148 to correspond to the nucleotides in an oligonucleotide probe downstream of the discriminating single nucleotide polymorphism.
tcyttattcatrgaytcyactactccyt

SEQ ID NO: 15351 - DNA, 28 bp, Artificial Sequence
  Pan degenerate oligonucleotide primer
  primer_bind (1)..(28)
  modified_base (1)..(1): base is a locked nucleic acid
  modified_base (19)..(19): base is a locked nucleic acid
  modified_base (21)..(21): base is a locked nucleic acid
  misc_feature (22)..(28): Adaptor region of the pan degenerate antisense primer that adapts the probe-binding site downstream of codon 148 to correspond to the nucleotides in an oligonucleotide probe downstream of the discriminating single nucleotide polymorphism.
tcyttattcatrgaytcyactactccyt

SEQ ID NO: 15352 - DNA, 28 bp, Artificial Sequence
  Pan degenerate oligonucleotide primer
  primer_bind (1)..(28)
  modified_base (1)..(1): base is a locked nucleic acid
  modified_base (10)..(10): base is a locked nucleic acid
  modified_base (21)..(21): base is a locked nucleic acid
  misc_feature (22)..(28): Adaptor region of the pan degenerate antisense primer that adapts the probe-binding site downstream of codon 148 to correspond to the nucleotides in an oligonucleotide probe downstream of the discriminating single nucleotide polymorphism.
tcyttattcatrgaytcyactactccyt

SEQ ID NO: 15353 - DNA, 19 bp, Artificial Sequence
  Pan degenerate oligonucleotide primer
  primer_bind (1)..(19)
  modified_base (1)..(1): base is a locked nucleic acid
  modified_base (10)..(10): base is a locked nucleic acid
  modified_base (12)..(12): base is a locked nucleic acid
  misc_feature (13)..(19): Adaptor region of the pan degenerate antisense primer that adapts the probe-binding site downstream of codon 148 to correspond to the nucleotides in an oligonucleotide probe downstream of the discriminating single nucleotide polymorphism.
atrgaytcyactactccyt

SEQ ID NO: 15354 - DNA, 19 bp, Artificial Sequence
  Pan degenerate oligonucleotide primer
  primer_bind (1)..(19)
  modified_base (1)..(1): base is a locked nucleic acid
  modified_base (12)..(12): base is a locked nucleic acid
  misc_feature (13)..(19): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (19)..(19): base is a locked nucleic acid
atrgaytcyactactccyt

SEQ ID NO: 15355 - DNA, 19 bp, Artificial Sequence
  Pan degenerate oligonucleotide primer
  primer_bind (1)..(19)
  modified_base (1)..(1): base is a locked nucleic acid
  modified_base (10)..(10): base is a locked nucleic acid
  misc_feature (13)..(19): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (19)..(19): base is a locked nucleic acid
atrgaytcyactactccyt

SEQ ID NO: 15356 - DNA, 40 bp, Artificial Sequence
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.
rattttctttaaytcyttattcatrgaytcyactactccy

SEQ ID NO: 15357 - DNA, 40 bp, Artificial Sequence; identical to SEQ ID NO: 15356
  Pan degenerate oligonucleotide primer
  primer_bind (1)..(40)
  modified_base (2)..(2): base is a locked nucleic acid
  modified_base (5)..(5): base is a locked nucleic acid
  modified_base (12)..(12): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15358 - DNA, 40 bp, Artificial Sequence; identical to SEQ ID NO: 15356
  Pan degenerate oligonucleotide primer
  primer_bind (1)..(40)
  modified_base (2)..(2): base is a locked nucleic acid
  modified_base (3)..(3): base is a locked nucleic acid
  modified_base (12)..(12): base is a locked nucleic acid
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15359 - DNA, 38 bp, Artificial Sequence
  Pan degenerate oligonucleotide primer
  primer_bind (1)..(38)
  modified_base (1)..(1): base is a locked nucleic acid
  modified_base (3)..(3): base is a locked nucleic acid
  modified_base (10)..(10): base is a locked nucleic acid
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.
ttttctttaaytcyttattcatrgaytcyactactccy

SEQ ID NO: 15360 - DNA, 38 bp, Artificial Sequence; identical to SEQ ID NO: 15359
  Pan degenerate oligonucleotide primer
  primer_bind (1)..(38)
  modified_base (1)..(1): base is a locked nucleic acid
  modified_base (10)..(10): base is a locked nucleic acid
  modified_base (19)..(19): base is a locked nucleic acid
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15361 - DNA, 38 bp, Artificial Sequence; identical to SEQ ID NO: 15359
  Pan degenerate oligonucleotide primer
  primer_bind (1)..(38)
  modified_base (1)..(1): base is a locked nucleic acid
  modified_base (3)..(3): base is a locked nucleic acid
  modified_base (19)..(19): base is a locked nucleic acid
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15362 - DNA, 36 bp, Artificial Sequence
  Pan degenerate oligonucleotide primer
  primer_bind (1)..(36)
  modified_base (1)..(1): base is a locked nucleic acid
  modified_base (8)..(8): base is a locked nucleic acid
  modified_base (17)..(17): base is a locked nucleic acid
  misc_feature (30)..(36): Adaptor region of the pan degenerate antisense primer that adapts the probe-binding site downstream of codon 148 to correspond to the nucleotides in an oligonucleotide probe downstream of the discriminating single nucleotide polymorphism.
ttctttaaytcyttattcatrgaytcyactactccy

SEQ ID NO: 15363 - DNA, 36 bp, Artificial Sequence; identical to SEQ ID NO: 15362
  Pan degenerate oligonucleotide primer
  primer_bind (1)..(36)
  modified_base (1)..(1): base is a locked nucleic acid
  modified_base (17)..(17): base is a locked nucleic acid
  modified_base (26)..(26): base is a locked nucleic acid
  misc_feature (30)..(36): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15364 - DNA, 36 bp, Artificial Sequence; identical to SEQ ID NO: 15362
  Pan degenerate oligonucleotide primer
  primer_bind (1)..(36)
  modified_base (1)..(1): base is a locked nucleic acid
  modified_base (8)..(8): base is a locked nucleic acid
  modified_base (26)..(26): base is a locked nucleic acid
  misc_feature (30)..(36): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15365 - DNA, 29 bp, Artificial Sequence
  Pan degenerate oligonucleotide primer
  primer_bind (1)..(29)
  modified_base (1)..(1): base is a locked nucleic acid
  modified_base (10)..(10): base is a locked nucleic acid
  modified_base (19)..(19): base is a locked nucleic acid
  misc_feature (23)..(29): Adaptor region of the pan degenerate antisense primer that adapts the probe-binding site downstream of codon 148 to correspond to the nucleotides in an oligonucleotide probe downstream of the discriminating single nucleotide polymorphism.
aytcyttattcatrgaytcyactactccy

SEQ ID NO: 15366 - DNA, 29 bp, Artificial Sequence
  Pan degenerate oligonucleotide primer
  primer_bind (1)..(29)
  modified_base (1)..(1): base is a locked nucleic acid
  modified_base (19)..(19): base is a locked nucleic acid
  modified_base (21)..(21): base is a locked nucleic acid
  misc_feature (23)..(29): Adaptor region of the pan degenerate antisense primer that adapts the probe-binding site downstream of codon 148 to correspond to the nucleotides in an oligonucleotide probe downstream of the discriminating single nucleotide polymorphism.
aytcyttattcatrgaytcyactactccy

SEQ ID NO: 15367 - DNA, 29 bp, Artificial Sequence
  Pan degenerate oligonucleotide primer
  primer_bind (1)..(29)
  modified_base (1)..(1): base is a locked nucleic acid
  modified_base (10)..(10): base is a locked nucleic acid
  modified_base (21)..(21): base is a locked nucleic acid
  misc_feature (23)..(29): Adaptor region of the pan degenerate antisense primer that adapts the probe-binding site downstream of codon 148 to correspond to the nucleotides in an oligonucleotide probe downstream of the discriminating single nucleotide polymorphism.
aytcyttattcatrgaytcyactactccy

SEQ ID NO: 15368 - DNA, 20 bp, Artificial Sequence
  Pan degenerate oligonucleotide primer
  primer_bind (1)..(20)
  modified_base (1)..(1): base is a locked nucleic acid
  modified_base (10)..(10): base is a locked nucleic acid
  modified_base (12)..(12): base is a locked nucleic acid
  misc_feature (14)..(20): Adaptor region of the pan degenerate antisense primer that adapts the probe-binding site downstream of codon 148 to correspond to the nucleotides in an oligonucleotide probe downstream of the discriminating single nucleotide polymorphism.
tcatrgaytcyactactccy

SEQ ID NO: 15369 - DNA, 20 bp, Artificial Sequence
  Pan degenerate oligonucleotide primer
  primer_bind (1)..(20)
  modified_base (1)..(1): base is a locked nucleic acid
  modified_base (12)..(12): base is a locked nucleic acid
  misc_feature (14)..(20): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (19)..(19): base is a locked nucleic acid
tcatrgaytcyactactccy

SEQ ID NO: 15370 - DNA, 20 bp, Artificial Sequence
  Pan degenerate oligonucleotide primer
  primer_bind (1)..(20)
  modified_base (1)..(1): base is a locked nucleic acid
  modified_base (10)..(10): base is a locked nucleic acid
  misc_feature (14)..(20): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (19)..(19): base is a locked nucleic acid
tcatrgaytcyactactccy

SEQ ID NO: 15371 - DNA, 40 bp, Artificial Sequence; identical to SEQ ID NO: 15323
  Pan degenerate oligonucleotide primer
  primer_bind (1)..(40)
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15372 - DNA, 39 bp, Artificial Sequence; identical to SEQ ID NO: 15326
  Pan degenerate oligonucleotide primer
  primer_bind (1)..(39)
  misc_feature (33)..(39): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15373 - DNA, 37 bp, Artificial Sequence; identical to SEQ ID NO: 15329
  Pan degenerate oligonucleotide primer
  primer_bind (1)..(37)
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15374 - DNA, 30 bp, Artificial Sequence; identical to SEQ ID NO: 15332
  Pan degenerate oligonucleotide primer
  primer_bind (1)..(30)
  misc_feature (24)..(30): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15375 - DNA, 21 bp, Artificial Sequence
  Pan degenerate oligonucleotide primer
  primer_bind (1)..(21)
  misc_feature (15)..(21): Adaptor region of the pan degenerate antisense primer that adapts the probe-binding site downstream of codon 148 to correspond to the nucleotides in an oligonucleotide probe downstream of the discriminating single nucleotide polymorphism.
attcatrgaytcyactactcc

SEQ ID NO: 15376 - DNA, 40 bp, Artificial Sequence; identical to SEQ ID NO: 15338
  Pan degenerate oligonucleotide primer
  primer_bind (1)..(40)
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15377 - DNA, 38 bp, Artificial Sequence; identical to SEQ ID NO: 15341
  Pan degenerate oligonucleotide primer
  primer_bind (1)..(38)
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15378 - DNA, 37 bp, Artificial Sequence; identical to SEQ ID NO: 15344
  Pan degenerate oligonucleotide primer
  primer_bind (1)..(37)
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15379 - DNA, 35 bp, Artificial Sequence; identical to SEQ ID NO: 15347
  Pan degenerate oligonucleotide primer
  primer_bind (1)..(35)
  misc_feature (29)..(35): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15380 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 148 to correspond to the nucleotides in an oligonucleotide probe downstream of the discriminating single nucleotide polymorphism.
tcyttattcatrgaytcyactactccyt

SEQ ID NO: 15381 - DNA, 19 bp, Artificial Sequence
  Pan degenerate oligonucleotide primer
  primer_bind (1)..(19)
  misc_feature (13)..(19): Adaptor region of the pan degenerate antisense primer that adapts the probe-binding site downstream of codon 148 to correspond to the nucleotides in an oligonucleotide probe downstream of the discriminating single nucleotide polymorphism.
atrgaytcyactactccyt

SEQ ID NO: 15382 - DNA, 40 bp, Artificial Sequence; identical to SEQ ID NO: 15356
  Pan degenerate oligonucleotide primer
  primer_bind (1)..(40)
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15383 - DNA, 38 bp, Artificial Sequence; identical to SEQ ID NO: 15359
  Pan degenerate oligonucleotide primer
  primer_bind (1)..(38)
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15384 - DNA, 36 bp, Artificial Sequence; identical to SEQ ID NO: 15362
  Pan degenerate oligonucleotide primer
  primer_bind (1)..(36)
  misc_feature (30)..(36): Adaptor region of the pan degenerate antisense primer that adapts the probe-binding site downstream of codon 148 to correspond to the nucleotides in an oligonucleotide probe downstream of the discriminating single nucleotide polymorphism.

SEQ ID NO: 15385 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 148 to correspond to the nucleotides in an oligonucleotide probe downstream of the discriminating single nucleotide polymorphism.
aytcyttattcatrgaytcyactactccy

SEQ ID NO: 15386 - DNA, 20 bp, Artificial Sequence
  Pan degenerate oligonucleotide primer
  primer_bind (1)..(20)
  misc_feature (14)..(20): Adaptor region of the pan degenerate antisense primer that adapts the probe-binding site downstream of codon 148 to correspond to the nucleotides in an oligonucleotide probe downstream of the discriminating single nucleotide polymorphism.
tcatrgaytcyactactccy

SEQ ID NO: 15387 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 148 to correspond to the nucleotides in an oligonucleotide probe downstream of the discriminating single nucleotide polymorphism.
kayytgyyctatratyttctttaaytchttattcatrgaytcyactactcc

SEQ ID NO: 15388 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
trattttctttaaytcyttattcatrgaytcyactactccn

SEQ ID NO: 15389 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
rattttctttaaytcyttattcatrgaytcyactactccn

SEQ ID NO: 15390 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ttttctttaaytcyttattcatrgaytcyactactccn

SEQ ID NO: 15391 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
taaytcyttattcatrgaytcyactactccn

SEQ ID NO: 15392 - DNA, 22 bp, Artificial Sequence
  Pan degenerate oligonucleotide primer
  primer_bind (1)..(22)
  misc_feature (15)..(21): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (22)..(22): base is a locked nucleic acid
  misc_feature (22)..(22): n is a, c, g, or t
attcatrgaytcyactactccn

SEQ ID NO: 15393 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
attttctttaaytcyttattcatrgaytcyactactccytn

SEQ ID NO: 15394 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
tttctttaaytcyttattcatrgaytcyactactccytn

SEQ ID NO: 15395 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ttctttaaytcyttattcatrgaytcyactactccytn

SEQ ID NO: 15396 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ctttaaytcyttattcatrgaytcyactactccytn

SEQ ID NO: 15397 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tcyttattcatrgaytcyactactccytn

SEQ ID NO: 15398 - DNA, 20 bp, Artificial Sequence
  Pan degenerate oligonucleotide primer
  primer_bind (1)..(20)
  misc_feature (13)..(19): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (20)..(20): base is a locked nucleic acid
  misc_feature (20)..(20): n is a, c, g, or t
atrgaytcyactactccytn

SEQ ID NO: 15399 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
rattttctttaaytcyttattcatrgaytcyactactccyn

SEQ ID NO: 15400 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ttttctttaaytcyttattcatrgaytcyactactccyn

SEQ ID NO: 15401 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
ttctttaaytcyttattcatrgaytcyactactccyn

SEQ ID NO: 15402 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
aytcyttattcatrgaytcyactactccyn

SEQ ID NO: 15403 - DNA, 21 bp, Artificial Sequence
  Pan degenerate oligonucleotide primer
  primer_bind (1)..(21)
  misc_feature (14)..(20): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (21)..(21): base is a locked nucleic acid
  misc_feature (21)..(21): n is a, c, g, or t
tcatrgaytcyactactccyn

SEQ ID NO: 15404 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 148 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
kayytgyyctatratyttctttaaytchttattcatrgaytcyactactccn

SEQ ID NO: 15405 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 153 to correspond to the nucleotides in an oligonucleotide probe downstream of the discriminating single nucleotide polymorphism.
ytcagcytgvtcyctkayytgyyctatratyttctttaaytchttattcat

SEQ ID NO: 15406 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 153 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ytcagcytgvtcyctkayytgyyctatratyttctttaaytchttattcatn

SEQ ID NO: 15407 - DNA, 40 bp, Artificial Sequence
  Pan degenerate oligonucleotide primer
  primer_bind (1)..(40)
  modified_base (1)..(1): base is a locked nucleic acid
  misc_feature (3)..(3): n is a, c, g, or t
  modified_base (10)..(10): base is a locked nucleic acid
  modified_base (12)..(12): base is a locked nucleic acid
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.
tgntcyctkacytgycctatrattttctttaaytcyttat

SEQ ID NO: 15408 - DNA, 40 bp, Artificial Sequence; identical to SEQ ID NO: 15407
  Pan degenerate oligonucleotide primer
  primer_bind (1)..(40)
  modified_base (1)..(1): base is a locked nucleic acid
  misc_feature (3)..(3): n is a, c, g, or t
  modified_base (12)..(12): base is a locked nucleic acid
  modified_base (19)..(19): base is a locked nucleic acid
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15409 - DNA, 40 bp, Artificial Sequence; identical to SEQ ID NO: 15407
  Pan degenerate oligonucleotide primer
  primer_bind (1)..(40)
  modified_base (1)..(1): base is a locked nucleic acid
  misc_feature (3)..(3): n is a, c, g, or t
  modified_base (10)..(10): base is a locked nucleic acid
  modified_base (19)..(19): base is a locked nucleic acid
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15410 - DNA, 31 bp, Artificial Sequence
  Pan degenerate oligonucleotide primer
  primer_bind (1)..(31)
  modified_base (1)..(1): base is a locked nucleic acid
  modified_base (3)..(3): base is a locked nucleic acid
  modified_base (10)..(10): base is a locked nucleic acid
  misc_feature (25)..(31): Adaptor region of the pan degenerate antisense primer that adapts the probe-binding site downstream of codon 155 to correspond to the nucleotides in an oligonucleotide probe downstream of the discriminating single nucleotide polymorphism.
acytgycctatrattttctttaaytcyttat

SEQ ID NO: 15411 - DNA, 31 bp, Artificial Sequence; identical to SEQ ID NO: 15410
  Pan degenerate oligonucleotide primer
  primer_bind (1)..(31)
  modified_base (1)..(1): base is a locked nucleic acid
  modified_base (10)..(10): base is a locked nucleic acid
  modified_base (13)..(13): base is a locked nucleic acid
  misc_feature (25)..(31): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15412 - DNA, 31 bp, Artificial Sequence; identical to SEQ ID NO: 15410
  Pan degenerate oligonucleotide primer
  primer_bind (1)..(31)
  modified_base (1)..(1): base is a locked nucleic acid
  modified_base (3)..(3): base is a locked nucleic acid
  modified_base (13)..(13): base is a locked nucleic acid
  misc_feature (25)..(31): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15413 - DNA, 29 bp, Artificial Sequence
  Pan degenerate oligonucleotide primer
  primer_bind (1)..(29)
  modified_base (1)..(1): base is a locked nucleic acid
  modified_base (8)..(8): base is a locked nucleic acid
  modified_base (11)..(11): base is a locked nucleic acid
  misc_feature (23)..(29): Adaptor region of the pan degenerate antisense primer that adapts the probe-binding site downstream of codon 155 to correspond to the nucleotides in an oligonucleotide probe downstream of the discriminating single nucleotide polymorphism.
ytgycctatrattttctttaaytcyttat

SEQ ID NO: 15414 - DNA, 29 bp, Artificial Sequence
  Pan degenerate oligonucleotide primer
  primer_bind (1)..(29)
  modified_base (1)..(1): base is a locked nucleic acid
  modified_base (11)..(11): base is a locked nucleic acid
  modified_base (17)..(17): base is a locked nucleic acid
  misc_feature (23)..(29): Adaptor region of the pan degenerate antisense primer that adapts the probe-binding site downstream of codon 155 to correspond to the nucleotides in an oligonucleotide probe downstream of the discriminating single nucleotide polymorphism.
ytgycctatrattttctttaaytcyttat

SEQ ID NO: 15415 - DNA, 29 bp, Artificial Sequence
  Pan degenerate oligonucleotide primer
  primer_bind (1)..(29)
  modified_base (1)..(1): base is a locked nucleic acid
  modified_base (8)..(8): base is a locked nucleic acid
  modified_base (17)..(17): base is a locked nucleic acid
  misc_feature (23)..(29): Adaptor region of the pan degenerate antisense primer that adapts the probe-binding site downstream of codon 155 to correspond to the nucleotides in an oligonucleotide probe downstream of the discriminating single nucleotide polymorphism.
ytgycctatrattttctttaaytcyttat

SEQ ID NO: 15416 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (10)..(10): base is a locked nucleic acid
  misc_feature (16)..(22): Adaptor region of the pan degenerate antisense primer that adapts the probe-binding site downstream of codon 155 to correspond to the nucleotides in an oligonucleotide probe downstream of the discriminating single nucleotide polymorphism.
atrattttctttaaytcyttat

SEQ ID NO: 15417 - DNA, 22 bp, Artificial Sequence
  Pan degenerate oligonucleotide primer
  primer_bind (1)..(22)
  modified_base (1)..(1): base is a locked nucleic acid
  modified_base (10)..(10): base is a locked nucleic acid
  misc_feature (16)..(22): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (19)..(19): base is a locked nucleic acid
atrattttctttaaytcyttat

SEQ ID NO: 15418 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  misc_feature (16)..(22): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (19)..(19): base is a locked nucleic acid
atrattttctttaaytcyttat

SEQ ID NO: 15419 - DNA, 19 bp, Artificial Sequence
  Pan degenerate oligonucleotide primer
  primer_bind (1)..(19)
  modified_base (1)..(1): base is a locked nucleic acid
  modified_base (7)..(7): base is a locked nucleic acid
  misc_feature (13)..(19): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (16)..(16): base is a locked nucleic acid
attttctttaaytcyttat

SEQ ID NO: 15420 - DNA, 19 bp, Artificial Sequence
  Pan degenerate oligonucleotide primer
  primer_bind (1)..(19)
  modified_base (1)..(1): base is a locked nucleic acid
  misc_feature (13)..(19): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (16)..(16): base is a locked nucleic acid
  modified_base (18)..(18): base is a locked nucleic acid
attttctttaaytcyttat

SEQ ID NO: 15421 - DNA, 19 bp, Artificial Sequence
  Pan degenerate oligonucleotide primer
  primer_bind (1)..(19)
  modified_base (1)..(1): base is a locked nucleic acid
  modified_base (7)..(7): base is a locked nucleic acid
  misc_feature (13)..(19): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (18)..(18): base is a locked nucleic acid
attttctttaaytcyttat

SEQ ID NO: 15422 - DNA, 13 bp, Artificial Sequence
  Pan degenerate oligonucleotide primer
  primer_bind (1)..(13)
  modified_base (1)..(1): base is a locked nucleic acid
  misc_feature (7)..(13): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (10)..(10): base is a locked nucleic acid
  modified_base (12)..(12): base is a locked nucleic acid
tttaaytcyttat

SEQ ID NO: 15423 - DNA, 13 bp, Artificial Sequence
  Pan degenerate oligonucleotide primer
  primer_bind (1)..(13)
  modified_base (1)..(1): base is a locked nucleic acid
  misc_feature (7)..(13): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (12)..(12): base is a locked nucleic acid
  modified_base (13)..(13): base is a locked nucleic acid
tttaaytcyttat

SEQ ID NO: 15424 - DNA, 13 bp, Artificial Sequence
  Pan degenerate oligonucleotide primer
  primer_bind (1)..(13)
  modified_base (1)..(1): base is a locked nucleic acid
  misc_feature (7)..(13): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (10)..(10): base is a locked nucleic acid
  modified_base (13)..(13): base is a locked nucleic acid
tttaaytcyttat

SEQ ID NO: 15425 - DNA, 40 bp, Artificial Sequence
  Pan degenerate oligonucleotide primer
  primer_bind (1)..(40)
  misc_feature (4)..(4): n is a, c, g, or t
  modified_base (9)..(9): base is a locked nucleic acid
  modified_base (11)..(11): base is a locked nucleic acid
  modified_base (18)..(18): base is a locked nucleic acid
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.
ytgntcyctkacytgycctatrattttctttaaytcytta

SEQ ID NO: 15426 - DNA, 40 bp, Artificial Sequence; identical to SEQ ID NO: 15425
  Pan degenerate oligonucleotide primer
  primer_bind (1)..(40)
  misc_feature (4)..(4): n is a, c, g, or t
  modified_base (9)..(9): base is a locked nucleic acid
  modified_base (18)..(18): base is a locked nucleic acid
  modified_base (21)..(21): base is a locked nucleic acid
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15427 - DNA, 40 bp, Artificial Sequence; identical to SEQ ID NO: 15425
  Pan degenerate oligonucleotide primer
  primer_bind (1)..(40)
  misc_feature (4)..(4): n is a, c, g, or t
  modified_base (9)..(9): base is a locked nucleic acid
  modified_base (11)..(11): base is a locked nucleic acid
  modified_base (21)..(21): base is a locked nucleic acid
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15428 - DNA, 30 bp, Artificial Sequence
  Pan degenerate oligonucleotide primer
  primer_bind (1)..(30)
  modified_base (1)..(1): base is a locked nucleic acid
  modified_base (8)..(8): base is a locked nucleic acid
  modified_base (11)..(11): base is a locked nucleic acid
  misc_feature (24)..(30): Adaptor region of the pan degenerate antisense primer that adapts the probe-binding site downstream of codon 155 to correspond to the nucleotides in an oligonucleotide probe downstream of the discriminating single nucleotide polymorphism.
acytgycctatrattttctttaaytcytta

SEQ ID NO: 15429 - DNA, 30 bp, Artificial Sequence; identical to SEQ ID NO: 15428
  Pan degenerate oligonucleotide primer
  primer_bind (1)..(30)
  modified_base (1)..(1): base is a locked nucleic acid
  modified_base (11)..(11): base is a locked nucleic acid
  modified_base (17)..(17): base is a locked nucleic acid
  misc_feature (24)..(30): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15430 - DNA, 30 bp, Artificial Sequence; identical to SEQ ID NO: 15428
  Pan degenerate oligonucleotide primer
  primer_bind (1)..(30)
  modified_base (1)..(1): base is a locked nucleic acid
  modified_base (8)..(8): base is a locked nucleic acid
  modified_base (17)..(17): base is a locked nucleic acid
  misc_feature (24)..(30): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15431 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (10)..(10): base is a locked nucleic acid
  misc_feature (17)..(23): Adaptor region of the pan degenerate antisense primer that adapts the probe-binding site downstream of codon 155 to correspond to the nucleotides in an oligonucleotide probe downstream of the discriminating single nucleotide polymorphism.
ctatrattttctttaaytcytta

SEQ ID NO: 15432 - DNA, 23 bp, Artificial Sequence
  Pan degenerate oligonucleotide primer
  primer_bind (1)..(23)
  modified_base (1)..(1): base is a locked nucleic acid
  modified_base (10)..(10): base is a locked nucleic acid
  misc_feature (17)..(23): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (19)..(19): base is a locked nucleic acid
ctatrattttctttaaytcytta

SEQ ID NO: 15433 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  misc_feature (17)..(23): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (19)..(19): base is a locked nucleic acid
ctatrattttctttaaytcytta

SEQ ID NO: 15434 - DNA, 20 bp, Artificial Sequence
  Pan degenerate oligonucleotide primer
  primer_bind (1)..(20)
  modified_base (1)..(1): base is a locked nucleic acid
  modified_base (7)..(7): base is a locked nucleic acid
  misc_feature (14)..(20): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (16)..(16): base is a locked nucleic acid
trattttctttaaytcytta

SEQ ID NO: 15435 - DNA, 20 bp, Artificial Sequence
  Pan degenerate oligonucleotide primer
  primer_bind (1)..(20)
  modified_base (1)..(1): base is a locked nucleic acid
  misc_feature (14)..(20): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (16)..(16): base is a locked nucleic acid
  modified_base (18)..(18): base is a locked nucleic acid
trattttctttaaytcytta

SEQ ID NO: 15436 - DNA, 20 bp, Artificial Sequence
  Pan degenerate oligonucleotide primer
  primer_bind (1)..(20)
  modified_base (1)..(1): base is a locked nucleic acid
  modified_base (7)..(7): base is a locked nucleic acid
  misc_feature (14)..(20): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (18)..(18): base is a locked nucleic acid
trattttctttaaytcytta

SEQ ID NO: 15437 - DNA, 14 bp, Artificial Sequence
  Pan degenerate oligonucleotide primer
  primer_bind (1)..(14)
  modified_base (1)..(1): base is a locked nucleic acid
  misc_feature (8)..(14): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (10)..(10): base is a locked nucleic acid
  modified_base (12)..(12): base is a locked nucleic acid
tctttaaytcytta

SEQ ID NO: 15438 - DNA, 14 bp, Artificial Sequence
  Pan degenerate oligonucleotide primer
  primer_bind (1)..(14)
  modified_base (1)..(1): base is a locked nucleic acid
  misc_feature (8)..(14): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (12)..(12): base is a locked nucleic acid
  modified_base (13)..(13): base is a locked nucleic acid
tctttaaytcytta

SEQ ID NO: 15439 - DNA, 14 bp, Artificial Sequence
  Pan degenerate oligonucleotide primer
  primer_bind (1)..(14)
  modified_base (1)..(1): base is a locked nucleic acid
  misc_feature (8)..(14): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (10)..(10): base is a locked nucleic acid
  modified_base (13)..(13): base is a locked nucleic acid
tctttaaytcytta

SEQ ID NO: 15440 - DNA, 40 bp, Artificial Sequence; identical to SEQ ID NO: 15407
  Pan degenerate oligonucleotide primer
  primer_bind (1)..(40)
  misc_feature (3)..(3): n is a, c, g, or t
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15441 - DNA, 31 bp, Artificial Sequence; identical to SEQ ID NO: 15410
  Pan degenerate oligonucleotide primer
  primer_bind (1)..(31)
  misc_feature (25)..(31): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15442 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 155 to correspond to the nucleotides in an oligonucleotide probe downstream of the discriminating single nucleotide polymorphism.
ytgycctatrattttctttaaytcyttat

SEQ ID NO: 15443 - DNA, 22 bp, Artificial Sequence
  Pan degenerate oligonucleotide primer
  primer_bind (1)..(22)
  misc_feature (16)..(22): Adaptor region of the pan degenerate antisense primer that adapts the probe-binding site downstream of codon 155 to correspond to the nucleotides in an oligonucleotide probe downstream of the discriminating single nucleotide polymorphism.
atrattttctttaaytcyttat

SEQ ID NO: 15444 - DNA, 19 bp, Artificial Sequence
  Pan degenerate oligonucleotide primer
  primer_bind (1)..(19)
  misc_feature (13)..(19): Adaptor region of the pan degenerate antisense primer that adapts the probe-binding site downstream of codon 155 to correspond to the nucleotides in an oligonucleotide probe downstream of the discriminating single nucleotide polymorphism.
attttctttaaytcyttat

SEQ ID NO: 15445 - DNA, 13 bp, Artificial Sequence
  Pan degenerate oligonucleotide primer
  primer_bind (1)..(13)
  misc_feature (7)..(13): Adaptor region of the pan degenerate antisense primer that adapts the probe-binding site downstream of codon 155 to correspond to the nucleotides in an oligonucleotide probe downstream of the discriminating single nucleotide polymorphism.
tttaaytcyttat

SEQ ID NO: 15446 - DNA, 40 bp, Artificial Sequence; identical to SEQ ID NO: 15425
  Pan degenerate oligonucleotide primer
  primer_bind (1)..(40)
  misc_feature (4)..(4): n is a, c, g, or t
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15447 - DNA, 30 bp, Artificial Sequence; identical to SEQ ID NO: 15428
  Pan degenerate oligonucleotide primer
  primer_bind (1)..(30)
  misc_feature (24)..(30): Adaptor region of the pan degenerate antisense primer that adapts the probe-binding site downstream of codon 155 to correspond to the nucleotides in an oligonucleotide probe downstream of the discriminating single nucleotide polymorphism.

SEQ ID NO: 15448 - DNA, 23 bp, Artificial Sequence
  Pan degenerate oligonucleotide primer
  primer_bind (1)..(23)
  misc_feature (17)..(23): Adaptor region of the pan degenerate antisense primer that adapts the probe-binding site downstream of codon 155 to correspond to the nucleotides in an oligonucleotide probe downstream of the discriminating single nucleotide polymorphism.
ctatrattttctttaaytcytta

SEQ ID NO: 15449 - DNA, 20 bp, Artificial Sequence
  Pan degenerate oligonucleotide primer
  primer_bind (1)..(20)
  misc_feature (14)..(20): Adaptor region of the pan degenerate antisense primer that adapts the probe-binding site downstream of codon 155 to correspond to the nucleotides in an oligonucleotide probe downstream of the discriminating single nucleotide polymorphism.
trattttctttaaytcytta

SEQ ID NO: 15450 - DNA, 14 bp, Artificial Sequence
  Pan degenerate oligonucleotide primer
  primer_bind (1)..(14)
  misc_feature (8)..(14): Adaptor region of the pan degenerate antisense primer that adapts the probe-binding site downstream of codon 155 to correspond to the nucleotides in an oligonucleotide probe downstream of the discriminating single nucleotide polymorphism.
tctttaaytcytta

SEQ ID NO: 15451 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 155 to correspond to the nucleotides in an oligonucleotide probe downstream of the discriminating single nucleotide polymorphism.
aagrtgytcagcytgvtcyctkayytgyyctatratyttctttaattcttt

SEQ ID NO: 15452 - DNA, 41 bp, Artificial Sequence
  Pan degenerate oligonucleotide primer
  primer_bind (1)..(41)
  misc_feature (3)..(3): n is a, c, g, or t
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tgntcyctkacytgycctatrattttctttaaytcyttatn

SEQ ID NO: 15453 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
acytgycctatrattttctttaaytcyttatn

SEQ ID NO: 15454 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
ytgycctatrattttctttaaytcyttatn

SEQ ID NO: 15455 - DNA, 23 bp, Artificial Sequence
  Pan degenerate oligonucleotide primer
  primer_bind (1)..(23)
  misc_feature (16)..(22): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (23)..(23): base is a locked nucleic acid
  misc_feature (23)..(23): n is a, c, g, or t
atrattttctttaaytcyttatn

SEQ ID NO: 15456 - DNA, 20 bp, Artificial Sequence
  Pan degenerate oligonucleotide primer
  primer_bind (1)..(20)
  misc_feature (13)..(19): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (20)..(20): base is a locked nucleic acid
  misc_feature (20)..(20): n is a, c, g, or t
attttctttaaytcyttatn

SEQ ID NO: 15457 - DNA, 14 bp, Artificial Sequence
  Pan degenerate oligonucleotide primer
  primer_bind (1)..(14)
  misc_feature (7)..(13): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (14)..(14): base is a locked nucleic acid
  misc_feature (14)..(14): n is a, c, g, or t
tttaaytcyttatn

SEQ ID NO: 15458 - DNA, 41 bp, Artificial Sequence
  Pan degenerate oligonucleotide primer
  primer_bind (1)..(41)
  misc_feature (4)..(4): n is a, c, g, or t
  misc_feature (34)..(40): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ytgntcyctkacytgycctatrattttctttaaytcyttan

SEQ ID NO: 15459 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
acytgycctatrattttctttaaytcyttan

SEQ ID NO: 15460 - DNA, 24 bp, Artificial Sequence
  Pan degenerate oligonucleotide primer
  primer_bind (1)..(24)
  misc_feature (17)..(23): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (24)..(24): base is a locked nucleic acid
  misc_feature (24)..(24): n is a, c, g, or t
ctatrattttctttaaytcyttan

SEQ ID NO: 15461 - DNA, 21 bp, Artificial Sequence
  Pan degenerate oligonucleotide primer
  primer_bind (1)..(21)
  misc_feature (14)..(20): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (21)..(21): base is a locked nucleic acid
  misc_feature (21)..(21): n is a, c, g, or t
trattttctttaaytcyttan

SEQ ID NO: 15462 - DNA, 15 bp, Artificial Sequence
  Pan degenerate oligonucleotide primer
  primer_bind (1)..(15)
  misc_feature (8)..(14): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (15)..(15): base is a locked nucleic acid
  misc_feature (15)..(15): n is a, c, g, or t
tctttaaytcyttan

SEQ ID NO: 15463 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 155 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
aagrtgytcagcytgvtcyctkayytgyyctatratyttctttaattctttn

SEQ ID NO: 15464 - DNA, 40 bp, Artificial Sequence
  Pan degenerate oligonucleotide primer
  primer_bind (1)..(40)
  modified_base (4)..(4): base is a locked nucleic acid
  modified_base (13)..(13): base is a locked nucleic acid
  modified_base (15)..(15): base is a locked nucleic acid
  misc_feature (27)..(27): n is a, c, g, or t
  misc_feature (34)..(40): Adaptor region of the pan degenerate antisense primer that adapts the probe-binding site downstream of codon 163 to correspond to the nucleotides in an oligonucleotide probe downstream of the discriminating single nucleotide polymorphism.
actgctgtyttaagrtgytcagcytgntcyctkacytgyc

SEQ ID NO: 15465 - DNA, 40 bp, Artificial Sequence; identical to SEQ ID NO: 15464
  Pan degenerate oligonucleotide primer
  primer_bind (1)..(40)
  modified_base (1)..(1): base is a locked nucleic acid
  modified_base (4)..(4): base is a locked nucleic acid
  modified_base (15)..(15): base is a locked nucleic acid
  misc_feature (27)..(27): n is a, c, g, or t
  misc_feature (34)..(40): Adaptor region of the pan degenerate antisense primer that adapts the probe-binding site downstream of codon 163 to correspond to the nucleotides in an oligonucleotide probe downstream of the discriminating single nucleotide polymorphism.

SEQ ID NO: 15466 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (15)..(15): n is a, c, g, or t
  misc_feature (22)..(28): Adaptor region of the pan degenerate antisense primer that adapts the probe-binding site downstream of codon 163 to correspond to the nucleotides in an oligonucleotide probe downstream of the discriminating single nucleotide polymorphism.
agrtgytcagcytgntcyctkacytgyc

SEQ ID NO: 15467 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  misc_feature (15)..(15): n is a, c, g, or t
  modified_base (21)..(21): base is a locked nucleic acid
  misc_feature (22)..(28): Adaptor region of the pan degenerate antisense primer that adapts the probe-binding site downstream of codon 163 to correspond to the nucleotides in an oligonucleotide probe downstream of the discriminating single nucleotide polymorphism.
agrtgytcagcytgntcyctkacytgyc

SEQ ID NO: 15468 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  misc_feature (15)..(15): n is a, c, g, or t
  modified_base (21)..(21): base is a locked nucleic acid
  misc_feature (22)..(28): Adaptor region of the pan degenerate antisense primer that adapts the probe-binding site downstream of codon 163 to correspond to the nucleotides in an oligonucleotide probe downstream of the discriminating single nucleotide polymorphism.
agrtgytcagcytgntcyctkacytgyc

SEQ ID NO: 15469 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  misc_feature (13)..(13): n is a, c, g, or t
  modified_base (19)..(19): base is a locked nucleic acid
  misc_feature (20)..(26): Adaptor region of the pan degenerate antisense primer that adapts the probe-binding site downstream of codon 163 to correspond to the nucleotides in an oligonucleotide probe downstream of the discriminating single nucleotide polymorphism.
rtgytcagcytgntcyctkacytgyc

SEQ ID NO: 15470 - DNA, 26 bp, Artificial Sequence
  Pan degenerate oligonucleotide primer
  primer_bind (1)..(26)
  modified_base (1)..(1): base is a locked nucleic acid
  misc_feature (13)..(13): n is a, c, g, or t
  modified_base (19)..(19): base is a locked nucleic acid
  misc_feature (20)..(26): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (20)..(20): base is a locked nucleic acid
rtgytcagcytgntcyctkacytgyc

SEQ ID NO: 15471 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  misc_feature (13)..(13): n is a, c, g, or t
  misc_feature (20)..(26): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (20)..(20): base is a locked nucleic acid
rtgytcagcytgntcyctkacytgyc

SEQ ID NO: 15472 - DNA, 25 bp, Artificial Sequence
  Pan degenerate oligonucleotide primer
  primer_bind (1)..(25)
  modified_base (1)..(1): base is a locked nucleic acid
  misc_feature (12)..(12): n is a, c, g, or t
  modified_base (18)..(18): base is a locked nucleic acid
  misc_feature (19)..(25): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (19)..(19): base is a locked nucleic acid
tgytcagcytgntcyctkacytgyc

SEQ ID NO: 15473 - DNA, 25 bp, Artificial Sequence
  Pan degenerate oligonucleotide primer
  primer_bind (1)..(25)
  modified_base (1)..(1): base is a locked nucleic acid
  misc_feature (12)..(12): n is a, c, g, or t
  misc_feature (19)..(25): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (19)..(19): base is a locked nucleic acid
  modified_base (21)..(21): base is a locked nucleic acid
tgytcagcytgntcyctkacytgyc

SEQ ID NO: 15474 - DNA, 25 bp, Artificial Sequence
  Pan degenerate oligonucleotide primer
  primer_bind (1)..(25)
  modified_base (1)..(1): base is a locked nucleic acid
  misc_feature (12)..(12): n is a, c, g, or t
  modified_base (18)..(18): base is a locked nucleic acid
  misc_feature (19)..(25): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (21)..(21): base is a locked nucleic acid
tgytcagcytgntcyctkacytgyc

SEQ ID NO: 15475 - DNA, 40 bp, Artificial Sequence; identical to SEQ ID NO: 15464
  Pan degenerate oligonucleotide primer
  primer_bind (1)..(40)
  misc_feature (27)..(27): n is a, c, g, or t
  misc_feature (34)..(40): Adaptor region of the pan degenerate antisense primer that adapts the probe-binding site downstream of codon 163 to correspond to the nucleotides in an oligonucleotide probe downstream of the discriminating single nucleotide polymorphism.

SEQ ID NO: 15476 - DNA, 28 bp, Artificial Sequence
  Pan degenerate oligonucleotide primer
  primer_bind (1)..(28)
  misc_feature (15)..(15): n is a, c, g, or t
  misc_feature (22)..(28): Adaptor region of the pan degenerate antisense primer that adapts the probe-binding site downstream of codon 163 to correspond to the nucleotides in an oligonucleotide probe downstream of the discriminating single nucleotide polymorphism.
agrtgytcagcytgntcyctkacytgyc

SEQ ID NO: 15477 - DNA, 26 bp, Artificial Sequence
  Pan degenerate oligonucleotide primer
  primer_bind (1)..(26)
  misc_feature (13)..(13): n is a, c, g, or t
  misc_feature (20)..(26): Adaptor region of the pan degenerate antisense primer that adapts the probe-binding site downstream of codon 163 to correspond to the nucleotides in an oligonucleotide probe downstream of the discriminating single nucleotide polymorphism.
rtgytcagcytgntcyctkacytgyc

SEQ ID NO: 15478 - DNA, 25 bp, Artificial Sequence
  Pan degenerate oligonucleotide primer
  primer_bind (1)..(25)
  misc_feature (12)..(12): n is a, c, g, or t
  misc_feature (19)..(25): Adaptor region of the pan degenerate antisense primer that adapts the probe-binding site downstream of codon 163 to correspond to the nucleotides in an oligonucleotide probe downstream of the discriminating single nucleotide polymorphism.
tgytcagcytgntcyctkacytgyc

SEQ ID NO: 15479 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 163 to correspond to the nucleotides in an oligonucleotide probe downstream of the discriminating single nucleotide polymorphism.
tactgccatytgtactgctgtyttaagrtgytcagcytgvtcycttacctg

SEQ ID NO: 15480 - DNA, 41 bp, Artificial Sequence
  Pan degenerate oligonucleotide primer
  primer_bind (1)..(41)
  misc_feature (27)..(27): n is a, c, g, or t
  misc_feature (34)..(40): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
actgctgtyttaagrtgytcagcytgntcyctkacytgycn

SEQ ID NO: 15481 - DNA, 29 bp, Artificial Sequence
  Pan degenerate oligonucleotide primer
  primer_bind (1)..(29)
  misc_feature (15)..(15): n is a, c, g, or t
  misc_feature (22)..(28): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
agrtgytcagcytgntcyctkacytgycn

SEQ ID NO: 15482 - DNA, 27 bp, Artificial Sequence
  Pan degenerate oligonucleotide primer
  primer_bind (1)..(27)
  misc_feature (13)..(13): n is a, c, g, or t
  misc_feature (20)..(26): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
rtgytcagcytgntcyctkacytgycn

SEQ ID NO: 15483 - DNA, 26 bp, Artificial Sequence
  Pan degenerate oligonucleotide primer
  primer_bind (1)..(26)
  misc_feature (12)..(12): n is a, c, g, or t
  misc_feature (19)..(25): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
tgytcagcytgntcyctkacytgycn

SEQ ID NO: 15484 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 163 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tactgccatytgtactgctgtyttaagrtgytcagcytgvtcycttacctgn

SEQ ID NO: 15485 - DNA, 40 bp, Artificial Sequence
  Pan degenerate oligonucleotide primer
  primer_bind (1)..(40)
  modified_base (2)..(2): base is a locked nucleic acid
  modified_base (5)..(5): base is a locked nucleic acid
  misc_feature (6)..(6): n is a, c, g, or t
  modified_base (7)..(7): base is a locked nucleic acid
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.
caragnagyttkgctggtcctttccaaakdggrtctctgc

SEQ ID NO: 15486 - DNA, 40 bp, Artificial Sequence; identical to SEQ ID NO: 15485
  Pan degenerate oligonucleotide primer
  primer_bind (1)..(40)
  modified_base (1)..(1): base is a locked nucleic acid
  modified_base (2)..(2): base is a locked nucleic acid
  misc_feature (6)..(6): n is a, c, g, or t
  modified_base (7)..(7): base is a locked nucleic acid
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15487 - DNA, 36 bp, Artificial Sequence
  Pan degenerate oligonucleotide primer
  primer_bind (1)..(36)
  modified_base (1)..(1): base is a locked nucleic acid
  misc_feature (2)..(2): n is a, c, g, or t
  modified_base (3)..(3): base is a locked nucleic acid
  modified_base (5)..(5): base is a locked nucleic acid
  misc_feature (30)..(36): Adaptor region of the pan degenerate antisense primer that adapts the probe-binding site downstream of codon 230 to correspond to the nucleotides in an oligonucleotide probe downstream of the discriminating single nucleotide polymorphism.
gnagyttkgctggtcctttccaaakdggrtctctgc

SEQ ID NO: 15488 - DNA, 36 bp, Artificial Sequence; identical to SEQ ID NO: 15487
  Pan degenerate oligonucleotide primer
  primer_bind (1)..(36)
  modified_base (1)..(1): base is a locked nucleic acid
  misc_feature (2)..(2): n is a, c, g, or t
  modified_base (5)..(5): base is a locked nucleic acid
  modified_base (6)..(6): base is a locked nucleic acid
  misc_feature (30)..(36): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15489 - DNA, 36 bp, Artificial Sequence; identical to SEQ ID NO: 15487
  Pan degenerate oligonucleotide primer
  primer_bind (1)..(36)
  modified_base (1)..(1): base is a locked nucleic acid
  misc_feature (2)..(2): n is a, c, g, or t
  modified_base (3)..(3): base is a locked nucleic acid
  modified_base (6)..(6): base is a locked nucleic acid
  misc_feature (30)..(36): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15490 - DNA, 34 bp, Artificial Sequence
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.
agyttkgctggtcctttccaaakdggrtctctgc

SEQ ID NO: 15491 - DNA, 34 bp, Artificial Sequence; identical to SEQ ID NO: 15490
  Pan degenerate oligonucleotide primer
  primer_bind (1)..(34)
  modified_base (1)..(1): base is a locked nucleic acid
  modified_base (4)..(4): base is a locked nucleic acid
  modified_base (9)..(9): base is a locked nucleic acid
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15492 - DNA, 34 bp, Artificial Sequence; identical to SEQ ID NO: 15490
  Pan degenerate oligonucleotide primer
  primer_bind (1)..(34)
  modified_base (1)..(1): base is a locked nucleic acid
  modified_base (3)..(3): base is a locked nucleic acid
  modified_base (9)..(9): base is a locked nucleic acid
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15493 - DNA, 32 bp, Artificial Sequence
  Pan degenerate oligonucleotide primer
  primer_bind (1)..(32)
  modified_base (1)..(1): base is a locked nucleic acid
  modified_base (2)..(2): base is a locked nucleic acid
  modified_base (7)..(7): base is a locked nucleic acid
  misc_feature (26)..(32): Adaptor region of the pan degenerate antisense primer that adapts the probe-binding site downstream of codon 230 to correspond to the nucleotides in an oligonucleotide probe downstream of the discriminating single nucleotide polymorphism.
yttkgctggtcctttccaaakdggrtctctgc

SEQ ID NO: 15494 - DNA, 32 bp, Artificial Sequence; identical to SEQ ID NO: 15493
  Pan degenerate oligonucleotide primer
  primer_bind (1)..(32)
  modified_base (1)..(1): base is a locked nucleic acid
  modified_base (7)..(7): base is a locked nucleic acid
  modified_base (8)..(8): base is a locked nucleic acid
  misc_feature (26)..(32): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15495 - DNA, 32 bp, Artificial Sequence; identical to SEQ ID NO: 15493
  Pan degenerate oligonucleotide primer
  primer_bind (1)..(32)
  modified_base (1)..(1): base is a locked nucleic acid
  modified_base (2)..(2): base is a locked nucleic acid
  modified_base (8)..(8): base is a locked nucleic acid
  misc_feature (26)..(32): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15496 - DNA, 31 bp, Artificial Sequence
  Pan degenerate oligonucleotide primer
  primer_bind (1)..(31)
  modified_base (1)..(1): base is a locked nucleic acid
  modified_base (6)..(6): base is a locked nucleic acid
  modified_base (7)..(7): base is a locked nucleic acid
  misc_feature (25)..(31): Adaptor region of the pan degenerate antisense primer that adapts the probe-binding site downstream of codon 230 to correspond to the nucleotides in an oligonucleotide probe downstream of the discriminating single nucleotide polymorphism.
ttkgctggtcctttccaaakdggrtctctgc

SEQ ID NO: 15497 - DNA, 31 bp, Artificial Sequence; identical to SEQ ID NO: 15496
  Pan degenerate oligonucleotide primer
  primer_bind (1)..(31)
  modified_base (1)..(1): base is a locked nucleic acid
  modified_base (7)..(7): base is a locked nucleic acid
  modified_base (8)..(8): base is a locked nucleic acid
  misc_feature (25)..(31): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15498 - DNA, 31 bp, Artificial Sequence; identical to SEQ ID NO: 15496
  Pan degenerate oligonucleotide primer
  primer_bind (1)..(31)
  modified_base (1)..(1): base is a locked nucleic acid
  modified_base (6)..(6): base is a locked nucleic acid
  modified_base (8)..(8): base is a locked nucleic acid
  misc_feature (25)..(31): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15499 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (3)..(3): base is a locked nucleic acid
  misc_feature (20)..(26): Adaptor region of the pan degenerate antisense primer that adapts the probe-binding site downstream of codon 230 to correspond to the nucleotides in an oligonucleotide probe downstream of the discriminating single nucleotide polymorphism.
tggtcctttccaaakdggrtctctgc

SEQ ID NO: 15500 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate antisense primer that adapts the probe-binding site downstream of codon 230 to correspond to the nucleotides in an oligonucleotide probe downstream of the discriminating single nucleotide polymorphism.
tggtcctttccaaakdggrtctctgc

SEQ ID NO: 15501 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (4)..(4): base is a locked nucleic acid
  misc_feature (20)..(26): Adaptor region of the pan degenerate antisense primer that adapts the probe-binding site downstream of codon 230 to correspond to the nucleotides in an oligonucleotide probe downstream of the discriminating single nucleotide polymorphism.
tggtcctttccaaakdggrtctctgc

SEQ ID NO: 15502 - DNA, 40 bp, Artificial Sequence; identical to SEQ ID NO: 15485
  Pan degenerate oligonucleotide primer
  primer_bind (1)..(40)
  misc_feature (6)..(6): n is a, c, g, or t
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15503 - DNA, 36 bp, Artificial Sequence; identical to SEQ ID NO: 15487
  Pan degenerate oligonucleotide primer
  primer_bind (1)..(36)
  misc_feature (2)..(2): n is a, c, g, or t
  misc_feature (30)..(36): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15504 - DNA, 34 bp, Artificial Sequence; identical to SEQ ID NO: 15490
  Pan degenerate oligonucleotide primer
  primer_bind (1)..(34)
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15505 - DNA, 32 bp, Artificial Sequence; identical to SEQ ID NO: 15493
  Pan degenerate oligonucleotide primer
  primer_bind (1)..(32)
  misc_feature (26)..(32): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15506 - DNA, 31 bp, Artificial Sequence; identical to SEQ ID NO: 15496
  Pan degenerate oligonucleotide primer
  primer_bind (1)..(31)
  misc_feature (25)..(31): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 15507 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 230 to correspond to the nucleotides in an oligonucleotide probe downstream of the discriminating single nucleotide polymorphism.
tggtcctttccaaakdggrtctctgc

SEQ ID NO: 15508 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 230 to correspond to the nucleotides in an oligonucleotide probe downstream of the discriminating single nucleotide polymorphism.
cccttcacctttccaragdagyttkgctggtcctttccaaabdgggtctct

SEQ ID NO: 15509 - DNA, 41 bp, Artificial Sequence
  Pan degenerate oligonucleotide primer
  primer_bind (1)..(41)
  misc_feature (6)..(6): n is a, c, g, or t
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
caragnagyttkgctggtcctttccaaakdggrtctctgcn

SEQ ID NO: 15510 - DNA, 37 bp, Artificial Sequence
  Pan degenerate oligonucleotide primer
  primer_bind (1)..(37)
  misc_feature (2)..(2): n is a, c, g, or t
  misc_feature (30)..(36): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
gnagyttkgctggtcctttccaaakdggrtctctgcn

SEQ ID NO: 15511 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
agyttkgctggtcctttccaaakdggrtctctgcn

SEQ ID NO: 15512 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
yttkgctggtcctttccaaakdggrtctctgcn

SEQ ID NO: 15513 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ttkgctggtcctttccaaakdggrtctctgcn

SEQ ID NO: 15514 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
tggtcctttccaaakdggrtctctgcn

SEQ ID NO: 15515 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
cccttcacctttccaragdagyttkgctggtcctttccaaabdgggtctctn

SEQ ID NO: 15516 - DNA, 40 bp, Artificial Sequence
  Pan degenerate oligonucleotide primer
  primer_bind (1)..(40)
  modified_base (2)..(2): base is a locked nucleic acid
  modified_base (8)..(8): base is a locked nucleic acid
  modified_base (9)..(9): base is a locked nucleic acid
  misc_feature (34)..(40): Adaptor region of the pan degenerate antisense primer that adapts the probe-binding site downstream of codon 263 to correspond to the nucleotides in an oligonucleotide probe downstream of the discriminating single nucleotide polymorphism.
tgccatctgttttccatartcyytaatratytttrcttty

SEQ ID NO: 15517 - DNA, 40 bp, Artificial Sequence; identical to SEQ ID NO: 15516
  Pan degenerate oligonucleotide primer
  primer_bind (1)..(40)
  modified_base (1)..(1): base is a locked nucleic acid
  modified_base (2)..(2): base is a locked nucleic acid
  modified_base (9)..(9): base is a locked nucleic acid
  misc_feature (34)..(40): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15518 - DNA, 33 bp, Artificial Sequence
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 263 to correspond to the nucleotides in an oligonucleotide probe downstream of the discriminating single nucleotide polymorphism.
tgttttccatartcyytaatratytttrcttty

SEQ ID NO: 15519 - DNA, 33 bp, Artificial Sequence; identical to SEQ ID NO: 15518
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15520 - DNA, 33 bp, Artificial Sequence; identical to SEQ ID NO: 15518
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15521 - DNA, 32 bp, Artificial Sequence
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 263 to correspond to the nucleotides in an oligonucleotide probe downstream of the discriminating single nucleotide polymorphism.
gttttccatartcyytaatratytttrcttty

SEQ ID NO: 15522 - DNA, 32 bp, Artificial Sequence; identical to SEQ ID NO: 15521
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15523 - DNA, 32 bp, Artificial Sequence; identical to SEQ ID NO: 15521
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (26)..(32): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15524 - DNA, 30 bp, Artificial Sequence
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 263 to correspond to the nucleotides in an oligonucleotide probe downstream of the discriminating single nucleotide polymorphism.
tttccatartcyytaatratytttrcttty

SEQ ID NO: 15525 - DNA, 30 bp, Artificial Sequence; identical to SEQ ID NO: 15524
  Pan degenerate oligonucleotide primer
  primer_bind (1)..(30)
  modified_base (1)..(1): base is a locked nucleic acid
  modified_base (5)..(5): base is a locked nucleic acid
  modified_base (16)..(16): base is a locked nucleic acid
  misc_feature (24)..(30): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15526 - DNA, 30 bp, Artificial Sequence; identical to SEQ ID NO: 15524
  Pan degenerate oligonucleotide primer
  primer_bind (1)..(30)
  modified_base (1)..(1): base is a locked nucleic acid
  modified_base (2)..(2): base is a locked nucleic acid
  modified_base (16)..(16): base is a locked nucleic acid
  misc_feature (24)..(30): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15527 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (15)..(15): base is a locked nucleic acid
  misc_feature (23)..(29): Adaptor region of the pan degenerate antisense primer that adapts the probe-binding site downstream of codon 263 to correspond to the nucleotides in an oligonucleotide probe downstream of the discriminating single nucleotide polymorphism.
ttccatartcyytaatratytttrcttty

SEQ ID NO: 15528 - DNA, 29 bp, Artificial Sequence
  Pan degenerate oligonucleotide primer
  primer_bind (1)..(29)
  modified_base (1)..(1): base is a locked nucleic acid
  modified_base (15)..(15): base is a locked nucleic acid
  modified_base (16)..(16): base is a locked nucleic acid
  misc_feature (23)..(29): Adaptor region of the pan degenerate antisense primer that adapts the probe-binding site downstream of codon 263 to correspond to the nucleotides in an oligonucleotide probe downstream of the discriminating single nucleotide polymorphism.
ttccatartcyytaatratytttrcttty

SEQ ID NO: 15529 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (16)..(16): base is a locked nucleic acid
  misc_feature (23)..(29): Adaptor region of the pan degenerate antisense primer that adapts the probe-binding site downstream of codon 263 to correspond to the nucleotides in an oligonucleotide probe downstream of the discriminating single nucleotide polymorphism.
ttccatartcyytaatratytttrcttty

SEQ ID NO: 15530 - DNA, 26 bp, Artificial Sequence
  Pan degenerate oligonucleotide primer
  primer_bind (1)..(26)
  modified_base (1)..(1): base is a locked nucleic acid
  modified_base (12)..(12): base is a locked nucleic acid
  modified_base (13)..(13): base is a locked nucleic acid
  misc_feature (20)..(26): Adaptor region of the pan degenerate antisense primer that adapts the probe-binding site downstream of codon 263 to correspond to the nucleotides in an oligonucleotide probe downstream of the discriminating single nucleotide polymorphism.
catartcyytaatratytttrcttty

SEQ ID NO: 15531 - DNA, 26 bp, Artificial Sequence
  Pan degenerate oligonucleotide primer
  primer_bind (1)..(26)
  modified_base (1)..(1): base is a locked nucleic acid
  modified_base (13)..(13): base is a locked nucleic acid
  modified_base (18)..(18): base is a locked nucleic acid
  misc_feature (20)..(26): Adaptor region of the pan degenerate antisense primer that adapts the probe-binding site downstream of codon 263 to correspond to the nucleotides in an oligonucleotide probe downstream of the discriminating single nucleotide polymorphism.
catartcyytaatratytttrcttty

SEQ ID NO: 15532 - DNA, 26 bp, Artificial Sequence
  Pan degenerate oligonucleotide primer
  primer_bind (1)..(26)
  modified_base (1)..(1): base is a locked nucleic acid
  modified_base (12)..(12): base is a locked nucleic acid
  modified_base (18)..(18): base is a locked nucleic acid
  misc_feature (20)..(26): Adaptor region of the pan degenerate antisense primer that adapts the probe-binding site downstream of codon 263 to correspond to the nucleotides in an oligonucleotide probe downstream of the discriminating single nucleotide polymorphism.
catartcyytaatratytttrcttty

SEQ ID NO: 15533 - DNA, 40 bp, Artificial Sequence; identical to SEQ ID NO: 15516
  Pan degenerate oligonucleotide primer
  primer_bind (1)..(40)
  misc_feature (34)..(40): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15534 - DNA, 33 bp, Artificial Sequence; identical to SEQ ID NO: 15518
  Pan degenerate oligonucleotide primer
  primer_bind (1)..(33)
  misc_feature (27)..(33): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15535 - DNA, 32 bp, Artificial Sequence; identical to SEQ ID NO: 15521
  Pan degenerate oligonucleotide primer
  primer_bind (1)..(32)
  misc_feature (26)..(32): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15536 - DNA, 30 bp, Artificial Sequence; identical to SEQ ID NO: 15524
  Pan degenerate oligonucleotide primer
  primer_bind (1)..(30)
  misc_feature (24)..(30): Adaptor region of the pan degenerate antisense primer that adapts the probe-binding site downstream of codon 263 to correspond to the nucleotides in an oligonucleotide probe downstream of the discriminating single nucleotide polymorphism.

SEQ ID NO: 15537 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 263 to correspond to the nucleotides in an oligonucleotide probe downstream of the discriminating single nucleotide polymorphism.
ttccatartcyytaatratytttrcttty

SEQ ID NO: 15538 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 263 to correspond to the nucleotides in an oligonucleotide probe downstream of the discriminating single nucleotide polymorphism.
catartcyytaatratytttrcttty

SEQ ID NO: 15539 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 263 to correspond to the nucleotides in an oligonucleotide probe downstream of the discriminating single nucleotide polymorphism.
acaatcakcacctgccatctgttttccatartcyytratratytttgcttt

SEQ ID NO: 15540 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 263 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tgccatctgttttccatartcyytaatratytttrctttyn

SEQ ID NO: 15541 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 263 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tgttttccatartcyytaatratytttrctttyn

SEQ ID NO: 15542 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 263 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
gttttccatartcyytaatratytttrctttyn

SEQ ID NO: 15543 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 263 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tttccatartcyytaatratytttrctttyn

SEQ ID NO: 15544 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 263 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
ttccatartcyytaatratytttrctttyn

SEQ ID NO: 15545 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 263 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
catartcyytaatratytttrctttyn

SEQ ID NO: 15546 - DNA, 15 bp, Artificial Sequence
  Oligonucleotide probe
  misc_binding (1)..(15): Hybridization probe for the specific detection of wild-type HIV-1 at codon 51 of the integrase gene.
agccatgcatggaca

SEQ ID NO: 15547 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (8)..(8): base is a locked nucleic acid
ytagaytgyacacayytag

SEQ ID NO: 15548 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (2)..(2): base is a locked nucleic acid
ytagaytgyacacayytag

SEQ ID NO: 15549 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (7)..(7): base is a locked nucleic acid
ytagaytgyacacayytag

SEQ ID NO: 15550 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (3)..(3): base is a locked nucleic acid
ytagaytgyacacayytag

SEQ ID NO: 15551 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (15)..(15): base is a locked nucleic acid
ytagaytgyacacayytag

SEQ ID NO: 15552 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (17)..(17): base is a locked nucleic acid
ytagaytgyacacayytag

SEQ ID NO: 15553 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (11)..(11): base is a locked nucleic acid
ytagaytgyacacayytag

SEQ ID NO: 15554 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (14)..(14): base is a locked nucleic acid
ytagaytgyacacayytag

SEQ ID NO: 15555 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (5)..(5): base is a locked nucleic acid
  modified_base (9)..(9): base is a locked nucleic acid
  modified_base (11)..(11): base is a locked nucleic acid
ytagaytgyacacayytag

SEQ ID NO: 15556 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (3)..(3): base is a locked nucleic acid
  modified_base (9)..(9): base is a locked nucleic acid
  modified_base (11)..(11): base is a locked nucleic acid
ytagaytgyacacayytag

SEQ ID NO: 15557 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (8)..(8): base is a locked nucleic acid
  modified_base (9)..(9): base is a locked nucleic acid
  modified_base (11)..(11): base is a locked nucleic acid
ytagaytgyacacayytag

SEQ ID NO: 15558 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (4)..(4): base is a locked nucleic acid
  modified_base (9)..(9): base is a locked nucleic acid
  modified_base (11)..(11): base is a locked nucleic acid
ytagaytgyacacayytag

SEQ ID NO: 15559 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (14)..(14): base is a locked nucleic acid
ytagaytgyacacayytag

SEQ ID NO: 15560 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (13)..(13): base is a locked nucleic acid
ytagaytgyacacayytag

SEQ ID NO: 15561 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (16)..(16): base is a locked nucleic acid
ytagaytgyacacayytag

SEQ ID NO: 15562 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (17)..(17): base is a locked nucleic acid
ytagaytgyacacayytag

SEQ ID NO: 15563 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (7)..(7): base is a locked nucleic acid
tagaytgyacacayytaga

SEQ ID NO: 15564 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (5)..(5): base is a locked nucleic acid
tagaytgyacacayytaga

SEQ ID NO: 15565 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (8)..(8): base is a locked nucleic acid
tagaytgyacacayytaga

SEQ ID NO: 15566 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (3)..(3): base is a locked nucleic acid
tagaytgyacacayytaga

SEQ ID NO: 15567 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (13)..(13): base is a locked nucleic acid
tagaytgyacacayytaga

SEQ ID NO: 15568 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (17)..(17): base is a locked nucleic acid
tagaytgyacacayytaga

SEQ ID NO: 15569 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (11)..(11): base is a locked nucleic acid
tagaytgyacacayytaga

SEQ ID NO: 15570 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (15)..(15): base is a locked nucleic acid
tagaytgyacacayytaga

SEQ ID NO: 15571 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (7)..(7): base is a locked nucleic acid
  modified_base (9)..(9): base is a locked nucleic acid
  modified_base (11)..(11): base is a locked nucleic acid
tagaytgyacacayytaga

SEQ ID NO: 15572 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (6)..(6): base is a locked nucleic acid
  modified_base (9)..(9): base is a locked nucleic acid
  modified_base (11)..(11): base is a locked nucleic acid
tagaytgyacacayytaga

SEQ ID NO: 15573 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (2)..(2): base is a locked nucleic acid
  modified_base (9)..(9): base is a locked nucleic acid
  modified_base (11)..(11): base is a locked nucleic acid
tagaytgyacacayytaga

SEQ ID NO: 15574 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (3)..(3): base is a locked nucleic acid
  modified_base (9)..(9): base is a locked nucleic acid
  modified_base (11)..(11): base is a locked nucleic acid
tagaytgyacacayytaga

SEQ ID NO: 15575 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (18)..(18): base is a locked nucleic acid
tagaytgyacacayytaga

SEQ ID NO: 15576 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (17)..(17): base is a locked nucleic acid
tagaytgyacacayytaga

SEQ ID NO: 15577 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (14)..(14): base is a locked nucleic acid
tagaytgyacacayytaga

SEQ ID NO: 15578 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (16)..(16): base is a locked nucleic acid
tagaytgyacacayytaga

SEQ ID NO: 15579 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (6)..(6): base is a locked nucleic acid
tagaytgyacacayytaga

SEQ ID NO: 15580 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (18)..(18): base is a locked nucleic acid
tagaytgyacacayytaga

SEQ ID NO: 15581 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (12)..(12): base is a locked nucleic acid
tagaytgyacacayytaga

SEQ ID NO: 15582 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (14)..(14): base is a locked nucleic acid
tagaytgyacacayytaga

SEQ ID NO: 15583 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (5)..(5): base is a locked nucleic acid
  modified_base (9)..(9): base is a locked nucleic acid
  modified_base (11)..(11): base is a locked nucleic acid
tagaytgyacacayytaga

SEQ ID NO: 15584 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (8)..(8): base is a locked nucleic acid
  modified_base (9)..(9): base is a locked nucleic acid
  modified_base (11)..(11): base is a locked nucleic acid
tagaytgyacacayytaga

SEQ ID NO: 15585 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (12)..(12): base is a locked nucleic acid
tagaytgyacacayytaga

SEQ ID NO: 15586 - DNA, 19 bp, Artificial Sequence
  Oligonucleotide probe
  misc_binding (1)..(19): Hybridization probe for the specific detection of wild-type HIV-1 at codon 66 of the integrase gene.
  modified_base (9)..(9): base is a locked nucleic acid
  modified_base (11)..(11): base is a locked nucleic acid
  modified_base (15)..(15): base is a locked nucleic acid
tagaytgyacacayytaga

SEQ ID NO: 15587 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (7)..(7): base is a locked nucleic acid
tagaytgyacacayyta

SEQ ID NO: 15588 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (1)..(1): base is a locked nucleic acid
tagaytgyacacayyta

SEQ ID NO: 15589 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (6)..(6): base is a locked nucleic acid
tagaytgyacacayyta

SEQ ID NO: 15590 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (2)..(2): base is a locked nucleic acid
tagaytgyacacayyta

SEQ ID NO: 15591 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (14)..(14): base is a locked nucleic acid
tagaytgyacacayyta

SEQ ID NO: 15592 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (16)..(16): base is a locked nucleic acid
tagaytgyacacayyta

SEQ ID NO: 15593 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (10)..(10): base is a locked nucleic acid
tagaytgyacacayyta

SEQ ID NO: 15594 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (13)..(13): base is a locked nucleic acid
tagaytgyacacayyta

SEQ ID NO: 15595 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (4)..(4): base is a locked nucleic acid
  modified_base (8)..(8): base is a locked nucleic acid
  modified_base (10)..(10): base is a locked nucleic acid
tagaytgyacacayyta

SEQ ID NO: 15596 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (2)..(2): base is a locked nucleic acid
  modified_base (8)..(8): base is a locked nucleic acid
  modified_base (10)..(10): base is a locked nucleic acid
tagaytgyacacayyta

SEQ ID NO: 15597 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (7)..(7): base is a locked nucleic acid
  modified_base (8)..(8): base is a locked nucleic acid
  modified_base (10)..(10): base is a locked nucleic acid
tagaytgyacacayyta

SEQ ID NO: 15598 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (3)..(3): base is a locked nucleic acid
  modified_base (8)..(8): base is a locked nucleic acid
  modified_base (10)..(10): base is a locked nucleic acid
tagaytgyacacayyta

SEQ ID NO: 15599 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (13)..(13): base is a locked nucleic acid
tagaytgyacacayyta

SEQ ID NO: 15600 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (12)..(12): base is a locked nucleic acid
tagaytgyacacayyta

SEQ ID NO: 15601 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (15)..(15): base is a locked nucleic acid
tagaytgyacacayyta

SEQ ID NO: 15602 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (16)..(16): base is a locked nucleic acid
tagaytgyacacayyta

SEQ ID NO: 15603 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (6)..(6): base is a locked nucleic acid
agaytgyacacayytag

SEQ ID NO: 15604 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (4)..(4): base is a locked nucleic acid
agaytgyacacayytag

SEQ ID NO: 15605 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (7)..(7): base is a locked nucleic acid
agaytgyacacayytag

SEQ ID NO: 15606 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (2)..(2): base is a locked nucleic acid
agaytgyacacayytag

SEQ ID NO: 15607 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (12)..(12): base is a locked nucleic acid
agaytgyacacayytag

SEQ ID NO: 15608 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (16)..(16): base is a locked nucleic acid
agaytgyacacayytag

SEQ ID NO: 15609 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (10)..(10): base is a locked nucleic acid
agaytgyacacayytag

SEQ ID NO: 15610 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (14)..(14): base is a locked nucleic acid
agaytgyacacayytag

SEQ ID NO: 15611 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (6)..(6): base is a locked nucleic acid
  modified_base (8)..(8): base is a locked nucleic acid
  modified_base (10)..(10): base is a locked nucleic acid
agaytgyacacayytag

SEQ ID NO: 15612 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (5)..(5): base is a locked nucleic acid
  modified_base (8)..(8): base is a locked nucleic acid
  modified_base (10)..(10): base is a locked nucleic acid
agaytgyacacayytag

SEQ ID NO: 15613 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (1)..(1): base is a locked nucleic acid
  modified_base (8)..(8): base is a locked nucleic acid
  modified_base (10)..(10): base is a locked nucleic acid
agaytgyacacayytag

SEQ ID NO: 15614 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (2)..(2): base is a locked nucleic acid
  modified_base (8)..(8): base is a locked nucleic acid
  modified_base (10)..(10): base is a locked nucleic acid
agaytgyacacayytag

SEQ ID NO: 15615 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (17)..(17): base is a locked nucleic acid
agaytgyacacayytag

SEQ ID NO: 15616 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (16)..(16): base is a locked nucleic acid
agaytgyacacayytag

SEQ ID NO: 15617 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (13)..(13): base is a locked nucleic acid
agaytgyacacayytag

SEQ ID NO: 15618 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (15)..(15): base is a locked nucleic acid
agaytgyacacayytag

SEQ ID NO: 15619 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (5)..(5): base is a locked nucleic acid
agaytgyacacayytag

SEQ ID NO: 15620 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (17)..(17): base is a locked nucleic acid
agaytgyacacayytag

SEQ ID NO: 15621 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (11)..(11): base is a locked nucleic acid
agaytgyacacayytag

SEQ ID NO: 15622 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (13)..(13): base is a locked nucleic acid
agaytgyacacayytag

SEQ ID NO: 15623 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (4)..(4): base is a locked nucleic acid
  modified_base (8)..(8): base is a locked nucleic acid
  modified_base (10)..(10): base is a locked nucleic acid
agaytgyacacayytag

SEQ ID NO: 15624 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (7)..(7): base is a locked nucleic acid
  modified_base (8)..(8): base is a locked nucleic acid
  modified_base (10)..(10): base is a locked nucleic acid
agaytgyacacayytag

SEQ ID NO: 15625 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (11)..(11): base is a locked nucleic acid
agaytgyacacayytag

SEQ ID NO: 15626 - DNA, 17 bp, Artificial Sequence
  Oligonucleotide probe
  misc_binding (1)..(17): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (14)..(14): base is a locked nucleic acid
agaytgyacacayytag

SEQ ID NO: 15627 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (7)..(7): base is a locked nucleic acid
tagaytgyacacayy

SEQ ID NO: 15628 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (1)..(1): base is a locked nucleic acid
tagaytgyacacayy

SEQ ID NO: 15629 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (6)..(6): base is a locked nucleic acid
tagaytgyacacayy

SEQ ID NO: 15630 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (2)..(2): base is a locked nucleic acid
tagaytgyacacayy

SEQ ID NO: 15631 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (14)..(14): base is a locked nucleic acid
tagaytgyacacayy

SEQ ID NO: 15632 - DNA, 15 bp, Artificial Sequence
  Oligonucleotide probe
  misc_binding (1)..(15): Hybridization probe for the specific detection of wild-type HIV-1 at codon 66 of the integrase gene.
tagaytgyacacayy

SEQ ID NO: 15633 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (10)..(10): base is a locked nucleic acid
tagaytgyacacayy

SEQ ID NO: 15634 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (13)..(13): base is a locked nucleic acid
tagaytgyacacayy

SEQ ID NO: 15635 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (4)..(4): base is a locked nucleic acid
  modified_base (8)..(8): base is a locked nucleic acid
  modified_base (10)..(10): base is a locked nucleic acid
tagaytgyacacayy

SEQ ID NO: 15636 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (2)..(2): base is a locked nucleic acid
  modified_base (8)..(8): base is a locked nucleic acid
  modified_base (10)..(10): base is a locked nucleic acid
tagaytgyacacayy

SEQ ID NO: 15637 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (7)..(7): base is a locked nucleic acid
  modified_base (8)..(8): base is a locked nucleic acid
  modified_base (10)..(10): base is a locked nucleic acid
tagaytgyacacayy

SEQ ID NO: 15638 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (3)..(3): base is a locked nucleic acid
  modified_base (8)..(8): base is a locked nucleic acid
  modified_base (10)..(10): base is a locked nucleic acid
tagaytgyacacayy

SEQ ID NO: 15639 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (13)..(13): base is a locked nucleic acid
tagaytgyacacayy

SEQ ID NO: 15640 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (12)..(12): base is a locked nucleic acid
tagaytgyacacayy

SEQ ID NO: 15641 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (15)..(15): base is a locked nucleic acid
tagaytgyacacayy

SEQ ID NO: 15642 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
tagaytgyacacayy

SEQ ID NO: 15643 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (6)..(6): base is a locked nucleic acid
agaytgyacacayyt

SEQ ID NO: 15644 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (4)..(4): base is a locked nucleic acid
agaytgyacacayyt

SEQ ID NO: 15645 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (7)..(7): base is a locked nucleic acid
agaytgyacacayyt

SEQ ID NO: 15646 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (2)..(2): base is a locked nucleic acid
agaytgyacacayyt

SEQ ID NO: 15647 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (12)..(12): base is a locked nucleic acid
agaytgyacacayyt

SEQ ID NO: 15648 - DNA, 15 bp, Artificial Sequence
  Oligonucleotide probe
  misc_binding (1)..(15): Hybridization probe for the specific detection of wild-type HIV-1 at codon 66 of the integrase gene.
agaytgyacacayyt

SEQ ID NO: 15649 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (10)..(10): base is a locked nucleic acid
agaytgyacacayyt

SEQ ID NO: 15650 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (14)..(14): base is a locked nucleic acid
agaytgyacacayyt

SEQ ID NO: 15651 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (6)..(6): base is a locked nucleic acid
  modified_base (8)..(8): base is a locked nucleic acid
  modified_base (10)..(10): base is a locked nucleic acid
agaytgyacacayyt

SEQ ID NO: 15652 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (5)..(5): base is a locked nucleic acid
  modified_base (8)..(8): base is a locked nucleic acid
  modified_base (10)..(10): base is a locked nucleic acid
agaytgyacacayyt

SEQ ID NO: 15653 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (1)..(1): base is a locked nucleic acid
  modified_base (8)..(8): base is a locked nucleic acid
  modified_base (10)..(10): base is a locked nucleic acid
agaytgyacacayyt

SEQ ID NO: 15654 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (2)..(2): base is a locked nucleic acid
  modified_base (8)..(8): base is a locked nucleic acid
  modified_base (10)..(10): base is a locked nucleic acid
agaytgyacacayyt

SEQ ID NO: 15655 - DNA, 16 bp, Artificial Sequence
  Oligonucleotide probe
  misc_binding (1)..(16): Hybridization probe for the specific detection of wild-type HIV-1 at codon 66 of the integrase gene.
  modified_base (8)..(8): base is a locked nucleic acid
  modified_base (10)..(10): base is a locked nucleic acid
agaytgyacacayyta

SEQ ID NO: 15656 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
agaytgyacacayyt

SEQ ID NO: 15657 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (13)..(13): base is a locked nucleic acid
agaytgyacacayyt

SEQ ID NO: 15658 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (15)..(15): base is a locked nucleic acid
agaytgyacacayyt

SEQ ID NO: 15659 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (5)..(5): base is a locked nucleic acid
agaytgyacacayyt

SEQ ID NO: 15660 - DNA, 16 bp, Artificial Sequence
  Oligonucleotide probe
  misc_binding (1)..(16): Hybridization probe for the specific detection of wild-type HIV-1 at codon 66 of the integrase gene.
agaytgyacacayyta

SEQ ID NO: 15661 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (11)..(11): base is a locked nucleic acid
agaytgyacacayyt

SEQ ID NO: 15662 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (13)..(13): base is a locked nucleic acid
agaytgyacacayyt

SEQ ID NO: 15663 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (4)..(4): base is a locked nucleic acid
  modified_base (8)..(8): base is a locked nucleic acid
  modified_base (10)..(10): base is a locked nucleic acid
agaytgyacacayyt

SEQ ID NO: 15664 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (7)..(7): base is a locked nucleic acid
  modified_base (8)..(8): base is a locked nucleic acid
  modified_base (10)..(10): base is a locked nucleic acid
agaytgyacacayyt

SEQ ID NO: 15665 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (11)..(11): base is a locked nucleic acid
agaytgyacacayyt

SEQ ID NO: 15666 - DNA, 15 bp, Artificial Sequence
  Oligonucleotide probe
  misc_binding (1)..(15): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (14)..(14): base is a locked nucleic acid
agaytgyacacayyt

SEQ ID NO: 15667 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (7)..(7): base is a locked nucleic acid
tagaytgyacaca

SEQ ID NO: 15668 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (1)..(1): base is a locked nucleic acid
tagaytgyacaca

SEQ ID NO: 15669 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (6)..(6): base is a locked nucleic acid
tagaytgyacaca

SEQ ID NO: 15670 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (2)..(2): base is a locked nucleic acid
tagaytgyacaca

SEQ ID NO: 15671 - DNA, 13 bp, Artificial Sequence
  Oligonucleotide probe
  misc_binding (1)..(13): Hybridization probe for the specific detection of wild-type HIV-1 at codon 66 of the integrase gene.
tagaytgyacaca

SEQ ID NO: 15672 - DNA, 14 bp, Artificial Sequence
  Oligonucleotide probe
  misc_binding (1)..(14): Hybridization probe for the specific detection of wild-type HIV-1 at codon 66 of the integrase gene.
tagaytgyacacay

SEQ ID NO: 15673 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (10)..(10): base is a locked nucleic acid
tagaytgyacaca

SEQ ID NO: 15674 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (13)..(13): base is a locked nucleic acid
tagaytgyacaca

SEQ ID NO: 15675 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (4)..(4): base is a locked nucleic acid
  modified_base (8)..(8): base is a locked nucleic acid
  modified_base (10)..(10): base is a locked nucleic acid
tagaytgyacaca

SEQ ID NO: 15676 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (2)..(2): base is a locked nucleic acid
  modified_base (8)..(8): base is a locked nucleic acid
  modified_base (10)..(10): base is a locked nucleic acid
tagaytgyacaca

SEQ ID NO: 15677 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (7)..(7): base is a locked nucleic acid
  modified_base (8)..(8): base is a locked nucleic acid
  modified_base (10)..(10): base is a locked nucleic acid
tagaytgyacaca

SEQ ID NO: 15678 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (3)..(3): base is a locked nucleic acid
  modified_base (8)..(8): base is a locked nucleic acid
  modified_base (10)..(10): base is a locked nucleic acid
tagaytgyacaca

SEQ ID NO: 15679 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (13)..(13): base is a locked nucleic acid
tagaytgyacaca

SEQ ID NO: 15680 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (12)..(12): base is a locked nucleic acid
tagaytgyacaca

SEQ ID NO: 15681 - DNA, 14 bp, Artificial Sequence
  Oligonucleotide probe
  misc_binding (1)..(14): Hybridization probe for the specific detection of wild-type HIV-1 at codon 66 of the integrase gene.
  modified_base (8)..(8): base is a locked nucleic acid
  modified_base (10)..(10): base is a locked nucleic acid
tagaytgyacacay

SEQ ID NO: 15682 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (6)..(6): base is a locked nucleic acid
agaytgyacacay

SEQ ID NO: 15683 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (4)..(4): base is a locked nucleic acid
agaytgyacacay

SEQ ID NO: 15684 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (7)..(7): base is a locked nucleic acid
agaytgyacacay

SEQ ID NO: 15685 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (2)..(2): base is a locked nucleic acid
agaytgyacacay

SEQ ID NO: 15686 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (12)..(12): base is a locked nucleic acid
agaytgyacacay

SEQ ID NO: 15687 - DNA, 14 bp, Artificial Sequence
  Oligonucleotide probe
  misc_binding (1)..(14): Hybridization probe for the specific detection of wild-type HIV-1 at codon 66 of the integrase gene.
agaytgyacacayy

SEQ ID NO: 15688 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (10)..(10): base is a locked nucleic acid
agaytgyacacay

SEQ ID NO: 15689 - DNA, 13 bp, Artificial Sequence
  Oligonucleotide probe
  misc_binding (1)..(13): Hybridization probe for the specific detection of wild-type HIV-1 at codon 66 of the integrase gene.
agaytgyacacay

SEQ ID NO: 15690 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (6)..(6): base is a locked nucleic acid
  modified_base (8)..(8): base is a locked nucleic acid
  modified_base (10)..(10): base is a locked nucleic acid
agaytgyacacay

SEQ ID NO: 15691 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (5)..(5): base is a locked nucleic acid
  modified_base (8)..(8): base is a locked nucleic acid
  modified_base (10)..(10): base is a locked nucleic acid
agaytgyacacay

SEQ ID NO: 15692 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (1)..(1): base is a locked nucleic acid
  modified_base (8)..(8): base is a locked nucleic acid
  modified_base (10)..(10): base is a locked nucleic acid
agaytgyacacay

SEQ ID NO: 15693 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (2)..(2): base is a locked nucleic acid
  modified_base (8)..(8): base is a locked nucleic acid
  modified_base (10)..(10): base is a locked nucleic acid
agaytgyacacay

SEQ ID NO: 15694 - DNA, 14 bp, Artificial Sequence
  Oligonucleotide probe
  misc_binding (1)..(14): Hybridization probe for the specific detection of wild-type HIV-1 at codon 66 of the integrase gene.
  modified_base (8)..(8): base is a locked nucleic acid
  modified_base (10)..(10): base is a locked nucleic acid
agaytgyacacayy

SEQ ID NO: 15695 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (13)..(13): base is a locked nucleic acid
agaytgyacacay

SEQ ID NO: 15696 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (5)..(5): base is a locked nucleic acid
agaytgyacacay

SEQ ID NO: 15697 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (11)..(11): base is a locked nucleic acid
agaytgyacacay

SEQ ID NO: 15698 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (13)..(13): base is a locked nucleic acid
agaytgyacacay

SEQ ID NO: 15699 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (4)..(4): base is a locked nucleic acid
  modified_base (8)..(8): base is a locked nucleic acid
  modified_base (10)..(10): base is a locked nucleic acid
agaytgyacacay

SEQ ID NO: 15700 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (7)..(7): base is a locked nucleic acid
  modified_base (8)..(8): base is a locked nucleic acid
  modified_base (10)..(10): base is a locked nucleic acid
agaytgyacacay

SEQ ID NO: 15701 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (8)..(8): base is a locked nucleic acid
  modified_base (10)..(10): base is a locked nucleic acid
  modified_base (11)..(11): base is a locked nucleic acid
agaytgyacacay

SEQ ID NO: 15702 - DNA, 13 bp, Artificial Sequence
  Oligonucleotide probe
  misc_binding (1)..(13): Hybridization probe for the specific detection of wild-type HIV-1 at codon 66 of the integrase gene.
  modified_base (8)..(8): base is a locked nucleic acid
  modified_base (10)..(10): base is a locked nucleic acid
agaytgyacacay

SEQ ID NO: 15703 - DNA, 19 bp, Artificial Sequence
  Oligonucleotide probe
  misc_binding (1)..(19): Hybridization probe for the specific detection of wild-type HIV-1 at codon 66 of the integrase gene.
ytagaytgyacacayytag

SEQ ID NO: 15704 - DNA, 19 bp, Artificial Sequence
  Oligonucleotide probe
  misc_binding (1)..(19): Hybridization probe for the specific detection of wild-type HIV-1 at codon 66 of the integrase gene.
tagaytgyacacayytaga

SEQ ID NO: 15705 - DNA, 17 bp, Artificial Sequence
  Oligonucleotide probe
  misc_binding (1)..(17): Hybridization probe for the specific detection of wild-type HIV-1 at codon 66 of the integrase gene.
tagaytgyacacayyta

SEQ ID NO: 15706 - DNA, 17 bp, Artificial Sequence
  Oligonucleotide probe
  misc_binding (1)..(17): Hybridization probe for the specific detection of wild-type HIV-1 at codon 66 of the integrase gene.
agaytgyacacayytag

SEQ ID NO: 15707 - DNA, 15 bp, Artificial Sequence
  Oligonucleotide probe
  misc_binding (1)..(15): Hybridization probe for the specific detection of wild-type HIV-1 at codon 66 of the integrase gene.
tagaytgyacacayy

SEQ ID NO: 15708 - DNA, 15 bp, Artificial Sequence
  Oligonucleotide probe
  misc_binding (1)..(15): Hybridization probe for the specific detection of wild-type HIV-1 at codon 66 of the integrase gene.
agaytgyacacayyt

SEQ ID NO: 15709 - DNA, 13 bp, Artificial Sequence
  Oligonucleotide probe
  misc_binding (1)..(13): Hybridization probe for the specific detection of wild-type HIV-1 at codon 66 of the integrase gene.
tagaytgyacaca

SEQ ID NO: 15710 - DNA, 13 bp, Artificial Sequence
  Oligonucleotide probe
  misc_binding (1)..(13): Hybridization probe for the specific detection of wild-type HIV-1 at codon 66 of the integrase gene.
agaytgyacacay

SEQ ID NO: 15711 - DNA, 15 bp, Artificial Sequence
  Oligonucleotide probe
  misc_binding (1)..(15): Hybridization probe for the specific detection of wild-type HIV-1 at codon 66 of the integrase gene.
taaatgkgtacaatc

SEQ ID NO: 15712 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (4)..(4): base is a locked nucleic acid
aaarthatyytrgtagcag

SEQ ID NO: 15713 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (2)..(2): base is a locked nucleic acid
aaarthatyytrgtagcag

SEQ ID NO: 15714 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (3)..(3): base is a locked nucleic acid
aaarthatyytrgtagcag

SEQ ID NO: 15715 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (7)..(7): base is a locked nucleic acid
aaarthatyytrgtagcag

SEQ ID NO: 15716 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (13)..(13): base is a locked nucleic acid
aaarthatyytrgtagcag

SEQ ID NO: 15717 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (18)..(18): base is a locked nucleic acid
aaarthatyytrgtagcag

SEQ ID NO: 15718 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (17)..(17): base is a locked nucleic acid
aaarthatyytrgtagcag

SEQ ID NO: 15719 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (19)..(19): base is a locked nucleic acid
aaarthatyytrgtagcag

SEQ ID NO: 15720 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (3)..(3): base is a locked nucleic acid
  modified_base (9)..(9): base is a locked nucleic acid
  modified_base (11)..(11): base is a locked nucleic acid
aaarthatyytrgtagcag

SEQ ID NO: 15721 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (2)..(2): base is a locked nucleic acid
  modified_base (9)..(9): base is a locked nucleic acid
  modified_base (11)..(11): base is a locked nucleic acid
aaarthatyytrgtagcag

SEQ ID NO: 15722 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (7)..(7): base is a locked nucleic acid
  modified_base (9)..(9): base is a locked nucleic acid
  modified_base (11)..(11): base is a locked nucleic acid
aaarthatyytrgtagcag

SEQ ID NO: 15723 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (4)..(4): base is a locked nucleic acid
  modified_base (9)..(9): base is a locked nucleic acid
  modified_base (11)..(11): base is a locked nucleic acid
aaarthatyytrgtagcag

SEQ ID NO: 15724 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (9)..(9): base is a locked nucleic acid
  modified_base (11)..(11): base is a locked nucleic acid
  modified_base (15)..(15): base is a locked nucleic acid
aaarthatyytrgtagcag

SEQ ID NO: 15725 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (9)..(9): base is a locked nucleic acid
  modified_base (11)..(11): base is a locked nucleic acid
  modified_base (14)..(14): base is a locked nucleic acid
aaarthatyytrgtagcag

SEQ ID NO: 15726 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (9)..(9): base is a locked nucleic acid
  modified_base (11)..(11): base is a locked nucleic acid
  modified_base (16)..(16): base is a locked nucleic acid
aaarthatyytrgtagcag

SEQ ID NO: 15727 - DNA, 19 bp, Artificial Sequence
  Oligonucleotide probe
  misc_binding (1)..(19): Hybridization probe for the specific detection of wild-type HIV-1 at codon 74 of the integrase gene.
  modified_base (9)..(9): base is a locked nucleic acid
  modified_base (11)..(11): base is a locked nucleic acid
  modified_base (13)..(13): base is a locked nucleic acid
aaarthatyytrgtagcag

SEQ ID NO: 15728 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (3)..(3): base is a locked nucleic acid
aarthatyytrgtagca

SEQ ID NO: 15729 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (1)..(1): base is a locked nucleic acid
aarthatyytrgtagca

SEQ ID NO: 15730 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (2)..(2): base is a locked nucleic acid
aarthatyytrgtagca

SEQ ID NO: 15731 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (6)..(6): base is a locked nucleic acid
aarthatyytrgtagca

SEQ ID NO: 15732 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (12)..(12): base is a locked nucleic acid
aarthatyytrgtagca

SEQ ID NO: 15733 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (17)..(17): base is a locked nucleic acid
aarthatyytrgtagca

SEQ ID NO: 15734 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (16)..(16): base is a locked nucleic acid
aarthatyytrgtagca

SEQ ID NO: 15735 - DNA, 17 bp, Artificial Sequence
  Oligonucleotide probe
  misc_binding (1)..(17): Hybridization probe for the specific detection of wild-type HIV-1 at codon 74 of the integrase gene.
aarthatyytrgtagca

SEQ ID NO: 15736 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (2)..(2): base is a locked nucleic acid
  modified_base (8)..(8): base is a locked nucleic acid
  modified_base (10)..(10): base is a locked nucleic acid
aarthatyytrgtagca

SEQ ID NO: 15737 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (1)..(1): base is a locked nucleic acid
  modified_base (8)..(8): base is a locked nucleic acid
  modified_base (10)..(10): base is a locked nucleic acid
aarthatyytrgtagca

SEQ ID NO: 15738 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (6)..(6): base is a locked nucleic acid
  modified_base (8)..(8): base is a locked nucleic acid
  modified_base (10)..(10): base is a locked nucleic acid
aarthatyytrgtagca

SEQ ID NO: 15739 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (3)..(3): base is a locked nucleic acid
  modified_base (8)..(8): base is a locked nucleic acid
  modified_base (10)..(10): base is a locked nucleic acid
aarthatyytrgtagca

SEQ ID NO: 15740 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (14)..(14): base is a locked nucleic acid
aarthatyytrgtagca

SEQ ID NO: 15741 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (13)..(13): base is a locked nucleic acid
aarthatyytrgtagca

SEQ ID NO: 15742 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (15)..(15): base is a locked nucleic acid
aarthatyytrgtagca

SEQ ID NO: 15743 - DNA, 17 bp, Artificial Sequence
  Oligonucleotide probe
  misc_binding (1)..(17): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (12)..(12): base is a locked nucleic acid
aarthatyytrgtagca

SEQ ID NO: 15744 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (3)..(3): base is a locked nucleic acid
aarthatyytrgtag

SEQ ID NO: 15745 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (1)..(1): base is a locked nucleic acid
aarthatyytrgtag

SEQ ID NO: 15746 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (2)..(2): base is a locked nucleic acid
aarthatyytrgtag

SEQ ID NO: 15747 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (6)..(6): base is a locked nucleic acid
aarthatyytrgtag

SEQ ID NO: 15748 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (12)..(12): base is a locked nucleic acid
aarthatyytrgtag

SEQ ID NO: 15749 - DNA, 16 bp, Artificial Sequence
  Oligonucleotide probe
  misc_binding (1)..(16): Hybridization probe for the specific detection of wild-type HIV-1 at codon 74 of the integrase gene.
aarthatyytrgtagc

SEQ ID NO: 15750 - DNA, 15 bp, Artificial Sequence
  Oligonucleotide probe
  misc_binding (1)..(15): Hybridization probe for the specific detection of wild-type HIV-1 at codon 74 of the integrase gene.
aarthatyytrgtag

SEQ ID NO: 15751 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (2)..(2): base is a locked nucleic acid
  modified_base (8)..(8): base is a locked nucleic acid
  modified_base (10)..(10): base is a locked nucleic acid
aarthatyytrgtag

SEQ ID NO: 15752 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (1)..(1): base is a locked nucleic acid
  modified_base (8)..(8): base is a locked nucleic acid
  modified_base (10)..(10): base is a locked nucleic acid
aarthatyytrgtag

SEQ ID NO: 15753 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (6)..(6): base is a locked nucleic acid
  modified_base (8)..(8): base is a locked nucleic acid
  modified_base (10)..(10): base is a locked nucleic acid
aarthatyytrgtag

SEQ ID NO: 15754 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (3)..(3): base is a locked nucleic acid
  modified_base (8)..(8): base is a locked nucleic acid
  modified_base (10)..(10): base is a locked nucleic acid
aarthatyytrgtag

SEQ ID NO: 15755 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (14)..(14): base is a locked nucleic acid
aarthatyytrgtag

SEQ ID NO: 15756 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (13)..(13): base is a locked nucleic acid
aarthatyytrgtag

SEQ ID NO: 15757 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (15)..(15): base is a locked nucleic acid
aarthatyytrgtag

SEQ ID NO: 15758 - DNA, 15 bp, Artificial Sequence
  Oligonucleotide probe
  misc_binding (1)..(15): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (12)..(12): base is a locked nucleic acid
aarthatyytrgtag

SEQ ID NO: 15759 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (3)..(3): base is a locked nucleic acid
aarthatyytrgt

SEQ ID NO: 15760 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (1)..(1): base is a locked nucleic acid
aarthatyytrgt

SEQ ID NO: 15761 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (2)..(2): base is a locked nucleic acid
aarthatyytrgt

SEQ ID NO: 15762 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (6)..(6): base is a locked nucleic acid
aarthatyytrgt

SEQ ID NO: 15763 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (12)..(12): base is a locked nucleic acid
aarthatyytrgt

SEQ ID NO: 15764 - DNA, 14 bp, Artificial Sequence
  Oligonucleotide probe
  misc_binding (1)..(14): Hybridization probe for the specific detection of wild-type HIV-1 at codon 74 of the integrase gene.
aarthatyytrgta

SEQ ID NO: 15765 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (2)..(2): base is a locked nucleic acid
  modified_base (8)..(8): base is a locked nucleic acid
  modified_base (10)..(10): base is a locked nucleic acid
aarthatyytrgt

SEQ ID NO: 15766 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (1)..(1): base is a locked nucleic acid
  modified_base (8)..(8): base is a locked nucleic acid
  modified_base (10)..(10): base is a locked nucleic acid
aarthatyytrgt

SEQ ID NO: 15767 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (6)..(6): base is a locked nucleic acid
  modified_base (8)..(8): base is a locked nucleic acid
  modified_base (10)..(10): base is a locked nucleic acid
aarthatyytrgt

SEQ ID NO: 15768 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (3)..(3): base is a locked nucleic acid
  modified_base (8)..(8): base is a locked nucleic acid
  modified_base (10)..(10): base is a locked nucleic acid
aarthatyytrgt

SEQ ID NO: 15769 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (8)..(8): base is a locked nucleic acid
  modified_base (10)..(10): base is a locked nucleic acid
aarthatyytrgt

SEQ ID NO: 15770 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (13)..(13): base is a locked nucleic acid
aarthatyytrgt

SEQ ID NO: 15771 - DNA, 14 bp, Artificial Sequence
  Oligonucleotide probe
  misc_binding (1)..(14): Hybridization probe for the specific detection of wild-type HIV-1 at codon 74 of the integrase gene.
  modified_base (8)..(8): base is a locked nucleic acid
  modified_base (10)..(10): base is a locked nucleic acid
aarthatyytrgta

SEQ ID NO: 15772 - DNA, 13 bp, Artificial Sequence
  Oligonucleotide probe
  misc_binding (1)..(13): Hybridization probe for the specific detection of wild-type HIV-1 at codon 74 of the integrase gene.
  modified_base (8)..(8): base is a locked nucleic acid
  modified_base (10)..(10): base is a locked nucleic acid
  modified_base (12)..(12): base is a locked nucleic acid
aarthatyytrgt

SEQ ID NO: 15773 - DNA, 19 bp, Artificial Sequence
  Oligonucleotide probe
  misc_binding (1)..(19): Hybridization probe for the specific detection of wild-type HIV-1 at codon 74 of the integrase gene.
aaarthatyytrgtagcag

SEQ ID NO: 15774 - DNA, 17 bp, Artificial Sequence
  Oligonucleotide probe
  misc_binding (1)..(17): Hybridization probe for the specific detection of wild-type HIV-1 at codon 74 of the integrase gene.
aarthatyytrgtagca

SEQ ID NO: 15775 - DNA, 15 bp, Artificial Sequence
  Oligonucleotide probe
  misc_binding (1)..(15): Hybridization probe for the specific detection of wild-type HIV-1 at codon 74 of the integrase gene.
aarthatyytrgtag

SEQ ID NO: 15776 - DNA, 13 bp, Artificial Sequence
  Oligonucleotide probe
  misc_binding (1)..(13): Hybridization probe for the specific detection of wild-type HIV-1 at codon 74 of the integrase gene.
aarthatyytrgt

SEQ ID NO: 15777 - DNA, 15 bp, Artificial Sequence
  Oligonucleotide probe
  misc_binding (1)..(15): Hybridization probe for the specific detection of wild-type HIV-1 at codon 74 of the integrase gene.
aattatcytrgtagc

SEQ ID NO: 15778 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (6)..(6): base is a locked nucleic acid
tyccagcagaracaggrca

SEQ ID NO: 15779 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
tyccagcagaracaggrca

SEQ ID NO: 15780 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (7)..(7): base is a locked nucleic acid
tyccagcagaracaggrca

SEQ ID NO: 15781 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (8)..(8): base is a locked nucleic acid
tyccagcagaracaggrca

SEQ ID NO: 15782 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (11)..(11): base is a locked nucleic acid
tyccagcagaracaggrca

SEQ ID NO: 15783 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (15)..(15): base is a locked nucleic acid
tyccagcagaracaggrca

SEQ ID NO: 15784 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (17)..(17): base is a locked nucleic acid
tyccagcagaracaggrca

SEQ ID NO: 15785 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (13)..(13): base is a locked nucleic acid
tyccagcagaracaggrca

SEQ ID NO: 15786 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (6)..(6): base is a locked nucleic acid
  modified_base (9)..(9): base is a locked nucleic acid
  modified_base (11)..(11): base is a locked nucleic acid
tyccagcagaracaggrca

SEQ ID NO: 15787 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (5)..(5): base is a locked nucleic acid
  modified_base (9)..(9): base is a locked nucleic acid
  modified_base (11)..(11): base is a locked nucleic acid
tyccagcagaracaggrca

SEQ ID NO: 15788 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (4)..(4): base is a locked nucleic acid
  modified_base (9)..(9): base is a locked nucleic acid
  modified_base (11)..(11): base is a locked nucleic acid
tyccagcagaracaggrca

SEQ ID NO: 15789 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (3)..(3): base is a locked nucleic acid
  modified_base (9)..(9): base is a locked nucleic acid
  modified_base (11)..(11): base is a locked nucleic acid
tyccagcagaracaggrca

SEQ ID NO: 15790 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (14)..(14): base is a locked nucleic acid
tyccagcagaracaggrca

SEQ ID NO: 15791 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (19)..(19): base is a locked nucleic acid
tyccagcagaracaggrca

SEQ ID NO: 15792 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (13)..(13): base is a locked nucleic acid
tyccagcagaracaggrca

SEQ ID NO: 15793 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (12)..(12): base is a locked nucleic acid
tyccagcagaracaggrca

SEQ ID NO: 15794 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (7)..(7): base is a locked nucleic acid
atyccagcagaracaggrc

SEQ ID NO: 15795 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (3)..(3): base is a locked nucleic acid
atyccagcagaracaggrc

SEQ ID NO: 15796 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (8)..(8): base is a locked nucleic acid
atyccagcagaracaggrc

SEQ ID NO: 15797 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (4)..(4): base is a locked nucleic acid
atyccagcagaracaggrc

SEQ ID NO: 15798 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (11)..(11): base is a locked nucleic acid
atyccagcagaracaggrc

SEQ ID NO: 15799 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (14)..(14): base is a locked nucleic acid
atyccagcagaracaggrc

SEQ ID NO: 15800 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (17)..(17): base is a locked nucleic acid
atyccagcagaracaggrc

SEQ ID NO: 15801 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (12)..(12): base is a locked nucleic acid
atyccagcagaracaggrc

SEQ ID NO: 15802 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (7)..(7): base is a locked nucleic acid
  modified_base (9)..(9): base is a locked nucleic acid
  modified_base (11)..(11): base is a locked nucleic acid
atyccagcagaracaggrc

SEQ ID NO: 15803 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (4)..(4): base is a locked nucleic acid
  modified_base (9)..(9): base is a locked nucleic acid
  modified_base (11)..(11): base is a locked nucleic acid
atyccagcagaracaggrc

SEQ ID NO: 15804 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (3)..(3): base is a locked nucleic acid
  modified_base (9)..(9): base is a locked nucleic acid
  modified_base (11)..(11): base is a locked nucleic acid
atyccagcagaracaggrc

SEQ ID NO: 15805 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (5)..(5): base is a locked nucleic acid
  modified_base (9)..(9): base is a locked nucleic acid
  modified_base (11)..(11): base is a locked nucleic acid
atyccagcagaracaggrc

SEQ ID NO: 15806 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (17)..(17): base is a locked nucleic acid
atyccagcagaracaggrc

SEQ ID NO: 15807 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (16)..(16): base is a locked nucleic acid
atyccagcagaracaggrc

SEQ ID NO: 15808 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (14)..(14): base is a locked nucleic acid
atyccagcagaracaggrc

SEQ ID NO: 15809 - DNA, 19 bp, Artificial Sequence
  Oligonucleotide probe
  misc_binding (1)..(19): Hybridization probe for the specific detection of wild-type HIV-1 at codon 92 of the integrase gene.
  modified_base (9)..(9): base is a locked nucleic acid
  modified_base (11)..(11): base is a locked nucleic acid
  modified_base (12)..(12): base is a locked nucleic acid
atyccagcagaracaggrc

SEQ ID NO: 15810 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (5)..(5): base is a locked nucleic acid
yccagcagaracaggrc

SEQ ID NO: 15811 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
yccagcagaracaggrc

SEQ ID NO: 15812 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (6)..(6): base is a locked nucleic acid
yccagcagaracaggrc

SEQ ID NO: 15813 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (7)..(7): base is a locked nucleic acid
yccagcagaracaggrc

SEQ ID NO: 15814 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (10)..(10): base is a locked nucleic acid
yccagcagaracaggrc

SEQ ID NO: 15815 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (14)..(14): base is a locked nucleic acid
yccagcagaracaggrc

SEQ ID NO: 15816 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (16)..(16): base is a locked nucleic acid
yccagcagaracaggrc

SEQ ID NO: 15817 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (12)..(12): base is a locked nucleic acid
yccagcagaracaggrc

SEQ ID NO: 15818 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (5)..(5): base is a locked nucleic acid
  modified_base (8)..(8): base is a locked nucleic acid
  modified_base (10)..(10): base is a locked nucleic acid
yccagcagaracaggrc

SEQ ID NO: 15819 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (4)..(4): base is a locked nucleic acid
  modified_base (8)..(8): base is a locked nucleic acid
  modified_base (10)..(10): base is a locked nucleic acid
yccagcagaracaggrc

SEQ ID NO: 15820 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (3)..(3): base is a locked nucleic acid
  modified_base (8)..(8): base is a locked nucleic acid
  modified_base (10)..(10): base is a locked nucleic acid
yccagcagaracaggrc

SEQ ID NO: 15821 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (2)..(2): base is a locked nucleic acid
  modified_base (8)..(8): base is a locked nucleic acid
  modified_base (10)..(10): base is a locked nucleic acid
yccagcagaracaggrc

SEQ ID NO: 15822 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (13)..(13): base is a locked nucleic acid
yccagcagaracaggrc

SEQ ID NO: 15823 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
yccagcagaracaggrc

SEQ ID NO: 15824 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (12)..(12): base is a locked nucleic acid
yccagcagaracaggrc

SEQ ID NO: 15825 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (11)..(11): base is a locked nucleic acid
yccagcagaracaggrc

SEQ ID NO: 15826 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (6)..(6): base is a locked nucleic acid
tyccagcagaracaggr

SEQ ID NO: 15827 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (2)..(2): base is a locked nucleic acid
tyccagcagaracaggr

SEQ ID NO: 15828 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (7)..(7): base is a locked nucleic acid
tyccagcagaracaggr

SEQ ID NO: 15829 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (3)..(3): base is a locked nucleic acid
tyccagcagaracaggr

SEQ ID NO: 15830 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (10)..(10): base is a locked nucleic acid
tyccagcagaracaggr

SEQ ID NO: 15831 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (13)..(13): base is a locked nucleic acid
tyccagcagaracaggr

SEQ ID NO: 15832 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (16)..(16): base is a locked nucleic acid
tyccagcagaracaggr

SEQ ID NO: 15833 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (11)..(11): base is a locked nucleic acid
tyccagcagaracaggr

SEQ ID NO: 15834 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (6)..(6): base is a locked nucleic acid
  modified_base (8)..(8): base is a locked nucleic acid
  modified_base (10)..(10): base is a locked nucleic acid
tyccagcagaracaggr

SEQ ID NO: 15835 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (3)..(3): base is a locked nucleic acid
  modified_base (8)..(8): base is a locked nucleic acid
  modified_base (10)..(10): base is a locked nucleic acid
tyccagcagaracaggr

SEQ ID NO: 15836 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (2)..(2): base is a locked nucleic acid
  modified_base (8)..(8): base is a locked nucleic acid
  modified_base (10)..(10): base is a locked nucleic acid
tyccagcagaracaggr

SEQ ID NO: 15837 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (4)..(4): base is a locked nucleic acid
  modified_base (8)..(8): base is a locked nucleic acid
  modified_base (10)..(10): base is a locked nucleic acid
tyccagcagaracaggr

SEQ ID NO: 15838 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (16)..(16): base is a locked nucleic acid
tyccagcagaracaggr

SEQ ID NO: 15839 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (15)..(15): base is a locked nucleic acid
tyccagcagaracaggr

SEQ ID NO: 15840 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (13)..(13): base is a locked nucleic acid
tyccagcagaracaggr

SEQ ID NO: 15841 - DNA, 17 bp, Artificial Sequence
  Oligonucleotide probe
  misc_binding (1)..(17): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (11)..(11): base is a locked nucleic acid
tyccagcagaracaggr

SEQ ID NO: 15842 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (5)..(5): base is a locked nucleic acid
yccagcagaracagg

SEQ ID NO: 15843 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
yccagcagaracagg

SEQ ID NO: 15844 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (6)..(6): base is a locked nucleic acid
yccagcagaracagg

SEQ ID NO: 15845 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (7)..(7): base is a locked nucleic acid
yccagcagaracagg

SEQ ID NO: 15846 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (10)..(10): base is a locked nucleic acid
yccagcagaracagg

SEQ ID NO: 15847 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (14)..(14): base is a locked nucleic acid
yccagcagaracagg

SEQ ID NO: 15848 - DNA, 15 bp, Artificial Sequence
  Oligonucleotide probe
  misc_binding (1)..(15): Hybridization probe for the specific detection of wild-type HIV-1 at codon 92 of the integrase gene.
yccagcagaracagg

SEQ ID NO: 15849 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (12)..(12): base is a locked nucleic acid
yccagcagaracagg

SEQ ID NO: 15850 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (5)..(5): base is a locked nucleic acid
  modified_base (8)..(8): base is a locked nucleic acid
  modified_base (10)..(10): base is a locked nucleic acid
yccagcagaracagg

SEQ ID NO: 15851 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (4)..(4): base is a locked nucleic acid
  modified_base (8)..(8): base is a locked nucleic acid
  modified_base (10)..(10): base is a locked nucleic acid
yccagcagaracagg

SEQ ID NO: 15852 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (3)..(3): base is a locked nucleic acid
  modified_base (8)..(8): base is a locked nucleic acid
  modified_base (10)..(10): base is a locked nucleic acid
yccagcagaracagg

SEQ ID NO: 15853 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (2)..(2): base is a locked nucleic acid
  modified_base (8)..(8): base is a locked nucleic acid
  modified_base (10)..(10): base is a locked nucleic acid
yccagcagaracagg

SEQ ID NO: 15854 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (13)..(13): base is a locked nucleic acid
yccagcagaracagg

SEQ ID NO: 15855 - DNA, 16 bp, Artificial Sequence
  Oligonucleotide probe
  misc_binding (1)..(16): Hybridization probe for the specific detection of wild-type HIV-1 at codon 92 of the integrase gene.
  modified_base (8)..(8): base is a locked nucleic acid
  modified_base (10)..(10): base is a locked nucleic acid
yccagcagaracaggr

SEQ ID NO: 15856 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (12)..(12): base is a locked nucleic acid
yccagcagaracagg

SEQ ID NO: 15857 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (11)..(11): base is a locked nucleic acid
yccagcagaracagg

SEQ ID NO: 15858 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (6)..(6): base is a locked nucleic acid
tyccagcagaracag

SEQ ID NO: 15859 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (2)..(2): base is a locked nucleic acid
tyccagcagaracag

SEQ ID NO: 15860 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (7)..(7): base is a locked nucleic acid
tyccagcagaracag

SEQ ID NO: 15861 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (3)..(3): base is a locked nucleic acid
tyccagcagaracag

SEQ ID NO: 15862 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (10)..(10): base is a locked nucleic acid
tyccagcagaracag

SEQ ID NO: 15863 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (13)..(13): base is a locked nucleic acid
tyccagcagaracag

SEQ ID NO: 15864 - DNA, 15 bp, Artificial Sequence
  Oligonucleotide probe
  misc_binding (1)..(15): Hybridization probe for the specific detection of wild-type HIV-1 at codon 92 of the integrase gene.
tyccagcagaracag

SEQ ID NO: 15865 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (11)..(11): base is a locked nucleic acid
tyccagcagaracag

SEQ ID NO: 15866 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (6)..(6): base is a locked nucleic acid
  modified_base (8)..(8): base is a locked nucleic acid
  modified_base (10)..(10): base is a locked nucleic acid
tyccagcagaracag

SEQ ID NO: 15867 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (3)..(3): base is a locked nucleic acid
  modified_base (8)..(8): base is a locked nucleic acid
  modified_base (10)..(10): base is a locked nucleic acid
tyccagcagaracag

SEQ ID NO: 15868 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (2)..(2): base is a locked nucleic acid
  modified_base (8)..(8): base is a locked nucleic acid
  modified_base (10)..(10): base is a locked nucleic acid
tyccagcagaracag

SEQ ID NO: 15869 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (4)..(4): base is a locked nucleic acid
  modified_base (8)..(8): base is a locked nucleic acid
  modified_base (10)..(10): base is a locked nucleic acid
tyccagcagaracag

SEQ ID NO: 15870 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
  modified_base (10)..(10): base is a locked nucleic acid
tyccagcagaracag

SEQ ID NO: 15871 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (15)..(15): base is a locked nucleic acid
tyccagcagaracag

SEQ ID NO: 15872 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (13)..(13): base is a locked nucleic acid
tyccagcagaracag

SEQ ID NO: 15873 - DNA, 15 bp, Artificial Sequence
  Oligonucleotide probe
  misc_binding (1)..(15): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (11)..(11): base is a locked nucleic acid
tyccagcagaracag

SEQ ID NO: 15874 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (5)..(5): base is a locked nucleic acid
yccagcagaraca

SEQ ID NO: 15875 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (8)..(8): base is a locked nucleic acid
yccagcagaraca

SEQ ID NO: 15876 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (6)..(6): base is a locked nucleic acid
yccagcagaraca

SEQ ID NO: 15877 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (7)..(7): base is a locked nucleic acid
yccagcagaraca

SEQ ID NO: 15878 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (10)..(10): base is a locked nucleic acid
yccagcagaraca

SEQ ID NO: 15879 - DNA, 13 bp, Artificial Sequence
  Oligonucleotide probe
  misc_binding (1)..(13): Hybridization probe for the specific detection of wild-type HIV-1 at codon 92 of the integrase gene.
yccagcagaraca

SEQ ID NO: 15880 - DNA, 14 bp, Artificial Sequence
  Oligonucleotide probe
  misc_binding (1)..(14): Hybridization probe for the specific detection of wild-type HIV-1 at codon 92 of the integrase gene.
yccagcagaracag

SEQ ID NO: 15881 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (12)..(12): base is a locked nucleic acid
yccagcagaraca

SEQ ID NO: 15882 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (5)..(5): base is a locked nucleic acid
  modified_base (8)..(8): base is a locked nucleic acid
  modified_base (10)..(10): base is a locked nucleic acid
yccagcagaraca

SEQ ID NO: 15883 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (4)..(4): base is a locked nucleic acid
  modified_base (8)..(8): base is a locked nucleic acid
  modified_base (10)..(10): base is a locked nucleic acid
yccagcagaraca

SEQ ID NO: 15884 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (3)..(3): base is a locked nucleic acid
  modified_base (8)..(8): base is a locked nucleic acid
  modified_base (10)..(10): base is a locked nucleic acid
yccagcagaraca

SEQ ID NO: 15885 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (2)..(2): base is a locked nucleic acid
  modified_base (8)..(8): base is a locked nucleic acid
  modified_base (10)..(10): base is a locked nucleic acid
yccagcagaraca

SEQ ID NO: 15886 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (13)..(13): base is a locked nucleic acid
yccagcagaraca

SEQ ID NO: 15887 - DNA, 14 bp, Artificial Sequence
  Oligonucleotide probe
  misc_binding (1)..(14): Hybridization probe for the specific detection of wild-type HIV-1 at codon 92 of the integrase gene.
  modified_base (8)..(8): base is a locked nucleic acid
  modified_base (10)..(10): base is a locked nucleic acid
yccagcagaracag

SEQ ID NO: 15888 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (12)..(12): base is a locked nucleic acid
yccagcagaraca

SEQ ID NO: 15889 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (11)..(11): base is a locked nucleic acid
yccagcagaraca

SEQ ID NO: 15890 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (6)..(6): base is a locked nucleic acid
tyccagcagarac

SEQ ID NO: 15891 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (2)..(2): base is a locked nucleic acid
tyccagcagarac

SEQ ID NO: 15892 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (7)..(7): base is a locked nucleic acid
tyccagcagarac

SEQ ID NO: 15893 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (3)..(3): base is a locked nucleic acid
tyccagcagarac

SEQ ID NO: 15894 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (10)..(10): base is a locked nucleic acid
tyccagcagarac

SEQ ID NO: 15895 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (13)..(13): base is a locked nucleic acid
tyccagcagarac

SEQ ID NO: 15896 - DNA, 14 bp, Artificial Sequence
  Oligonucleotide probe
  misc_binding (1)..(14): Hybridization probe for the specific detection of wild-type HIV-1 at codon 92 of the integrase gene.
tyccagcagaraca

SEQ ID NO: 15897 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (11)..(11): base is a locked nucleic acid
tyccagcagarac

SEQ ID NO: 15898 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (6)..(6): base is a locked nucleic acid
  modified_base (8)..(8): base is a locked nucleic acid
  modified_base (10)..(10): base is a locked nucleic acid
tyccagcagarac

SEQ ID NO: 15899 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (3)..(3): base is a locked nucleic acid
  modified_base (8)..(8): base is a locked nucleic acid
  modified_base (10)..(10): base is a locked nucleic acid
tyccagcagarac

SEQ ID NO: 15900 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (2)..(2): base is a locked nucleic acid
  modified_base (8)..(8): base is a locked nucleic acid
  modified_base (10)..(10): base is a locked nucleic acid
tyccagcagarac

SEQ ID NO: 15901 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (4)..(4): base is a locked nucleic acid
  modified_base (8)..(8): base is a locked nucleic acid
  modified_base (10)..(10): base is a locked nucleic acid
tyccagcagarac

SEQ ID NO: 15902 - DNA, 14 bp, Artificial Sequence
  Oligonucleotide probe
  misc_binding (1)..(14): Hybridization probe for the specific detection of wild-type HIV-1 at codon 92 of the integrase gene.
  modified_base (8)..(8): base is a locked nucleic acid
  modified_base (10)..(10): base is a locked nucleic acid
tyccagcagaraca

SEQ ID NO: 15903 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (13)..(13): base is a locked nucleic acid
tyccagcagarac

SEQ ID NO: 15904 - DNA, 13 bp, Artificial Sequence
  Oligonucleotide probe
  misc_binding (1)..(13): Hybridization probe for the specific detection of wild-type HIV-1 at codon 92 of the integrase gene.
  modified_base (8)..(8): base is a locked nucleic acid
  modified_base (10)..(10): base is a locked nucleic acid
  modified_base (11)..(11): base is a locked nucleic acid
tyccagcagarac

SEQ ID NO: 15905 - DNA, 19 bp, Artificial Sequence
  Oligonucleotide probe
  misc_binding (1)..(19): Hybridization probe for the specific detection of wild-type HIV-1 at codon 92 of the integrase gene.
tyccagcagaracaggrca

SEQ ID NO: 15906 - DNA, 19 bp, Artificial Sequence
  Oligonucleotide probe
  misc_binding (1)..(19): Hybridization probe for the specific detection of wild-type HIV-1 at codon 92 of the integrase gene.
atyccagcagaracaggrc

SEQ ID NO: 15907 - DNA, 17 bp, Artificial Sequence
  Oligonucleotide probe
  misc_binding (1)..(17): Hybridization probe for the specific detection of wild-type HIV-1 at codon 92 of the integrase gene.
yccagcagaracaggrc

SEQ ID NO: 15908 - DNA, 17 bp, Artificial Sequence
  Oligonucleotide probe
  misc_binding (1)..(17): Hybridization probe for the specific detection of wild-type HIV-1 at codon 92 of the integrase gene.
tyccagcagaracaggr

SEQ ID NO: 15909 - DNA, 15 bp, Artificial Sequence
  Oligonucleotide probe
  misc_binding (1)..(15): Hybridization probe for the specific detection of wild-type HIV-1 at codon 92 of the integrase gene.
yccagcagaracagg

SEQ ID NO: 15910 - DNA, 16 bp, Artificial Sequence
  Oligonucleotide probe
  misc_binding (1)..(16): Hybridization probe for the specific detection of wild-type HIV-1 at codon 92 of the integrase gene.
yccagcagaracaggr

SEQ ID NO: 15911 - DNA, 15 bp, Artificial Sequence
  Oligonucleotide probe
  misc_binding (1)..(15): Hybridization probe for the specific detection of wild-type HIV-1 at codon 92 of the integrase gene.
tyccagcagaracag

SEQ ID NO: 15912 - DNA, 13 bp, Artificial Sequence
  Oligonucleotide probe
  misc_binding (1)..(13): Hybridization probe for the specific detection of wild-type HIV-1 at codon 92 of the integrase gene.
yccagcagaraca

SEQ ID NO: 15913 - DNA, 13 bp, Artificial Sequence
  Oligonucleotide probe
  misc_binding (1)..(13): Hybridization probe for the specific detection of wild-type HIV-1 at codon 92 of the integrase gene.
tyccagcagarac

SEQ ID NO: 15914 - DNA, 15 bp, Artificial Sequence
  Oligonucleotide probe
  misc_binding (1)..(15): Hybridization probe for the specific detection of wild-type HIV-1 at codon 92 of the integrase gene.
cccagcagaracagg

SEQ ID NO: 15915 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (3)..(3): base is a locked nucleic acid
ggrcargaracagcatayt

SEQ ID NO: 15916 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (8)..(8): base is a locked nucleic acid
ggrcargaracagcatayt

SEQ ID NO: 15917 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (2)..(2): base is a locked nucleic acid
ggrcargaracagcatayt

SEQ ID NO: 15918 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (9)..(9): base is a locked nucleic acid
ggrcargaracagcatayt

SEQ ID NO: 15919 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (14)..(14): base is a locked nucleic acid
ggrcargaracagcatayt

SEQ ID NO: 15920 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (19)..(19): base is a locked nucleic acid
ggrcargaracagcatayt

SEQ ID NO: 15921 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (12)..(12): base is a locked nucleic acid
ggrcargaracagcatayt

SEQ ID NO: 15922 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (13)..(13): base is a locked nucleic acid
ggrcargaracagcatayt

SEQ ID NO: 15923 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (3)..(3): base is a locked nucleic acid
  modified_base (9)..(9): base is a locked nucleic acid
  modified_base (11)..(11): base is a locked nucleic acid
ggrcargaracagcatayt

SEQ ID NO: 15924 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (5)..(5): base is a locked nucleic acid
  modified_base (9)..(9): base is a locked nucleic acid
  modified_base (11)..(11): base is a locked nucleic acid
ggrcargaracagcatayt

SEQ ID NO: 15925 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (4)..(4): base is a locked nucleic acid
  modified_base (9)..(9): base is a locked nucleic acid
  modified_base (11)..(11): base is a locked nucleic acid
ggrcargaracagcatayt

SEQ ID NO: 15926 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (2)..(2): base is a locked nucleic acid
  modified_base (9)..(9): base is a locked nucleic acid
  modified_base (11)..(11): base is a locked nucleic acid
ggrcargaracagcatayt

SEQ ID NO: 15927 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (9)..(9): base is a locked nucleic acid
  modified_base (11)..(11): base is a locked nucleic acid
  modified_base (19)..(19): base is a locked nucleic acid
ggrcargaracagcatayt

SEQ ID NO: 15928 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (9)..(9): base is a locked nucleic acid
  modified_base (11)..(11): base is a locked nucleic acid
  modified_base (16)..(16): base is a locked nucleic acid
ggrcargaracagcatayt

SEQ ID NO: 15929 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (9)..(9): base is a locked nucleic acid
  modified_base (11)..(11): base is a locked nucleic acid
  modified_base (15)..(15): base is a locked nucleic acid
ggrcargaracagcatayt

SEQ ID NO: 15930 - DNA, 19 bp, Artificial Sequence
  Oligonucleotide probe
  misc_binding (1)..(19): Hybridization probe for the specific detection of wild-type HIV-1 at codon 97 of the integrase gene.
  modified_base (9)..(9): base is a locked nucleic acid
  modified_base (11)..(11): base is a locked nucleic acid
  modified_base (13)..(13): base is a locked nucleic acid
ggrcargaracagcatayt

SEQ ID NO: 15931 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (2)..(2): base is a locked nucleic acid
grcargaracagcatay

SEQ ID NO: 15932 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (7)..(7): base is a locked nucleic acid
grcargaracagcatay

SEQ ID NO: 15933 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (1)..(1): base is a locked nucleic acid
grcargaracagcatay

SEQ ID NO: 15934 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (8)..(8): base is a locked nucleic acid
grcargaracagcatay

SEQ ID NO: 15935 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (13)..(13): base is a locked nucleic acid
grcargaracagcatay

SEQ ID NO: 15936 - DNA, 17 bp, Artificial Sequence
  Oligonucleotide probe
  misc_binding (1)..(17): Hybridization probe for the specific detection of wild-type HIV-1 at codon 97 of the integrase gene.
grcargaracagcatay

SEQ ID NO: 15937 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (11)..(11): base is a locked nucleic acid
grcargaracagcatay

SEQ ID NO: 15938 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (12)..(12): base is a locked nucleic acid
grcargaracagcatay

SEQ ID NO: 15939 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (2)..(2): base is a locked nucleic acid
  modified_base (8)..(8): base is a locked nucleic acid
  modified_base (10)..(10): base is a locked nucleic acid
grcargaracagcatay

SEQ ID NO: 15940 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (4)..(4): base is a locked nucleic acid
  modified_base (8)..(8): base is a locked nucleic acid
  modified_base (10)..(10): base is a locked nucleic acid
grcargaracagcatay

SEQ ID NO: 15941 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (3)..(3): base is a locked nucleic acid
  modified_base (8)..(8): base is a locked nucleic acid
  modified_base (10)..(10): base is a locked nucleic acid
grcargaracagcatay

SEQ ID NO: 15942 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (1)..(1): base is a locked nucleic acid
  modified_base (8)..(8): base is a locked nucleic acid
  modified_base (10)..(10): base is a locked nucleic acid
grcargaracagcatay

SEQ ID NO: 15943 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (8)..(8): base is a locked nucleic acid
  modified_base (10)..(10): base is a locked nucleic acid
grcargaracagcatay

SEQ ID NO: 15944 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (8)..(8): base is a locked nucleic acid
  modified_base (10)..(10): base is a locked nucleic acid
  modified_base (15)..(15): base is a locked nucleic acid
grcargaracagcatay

SEQ ID NO: 15945 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (8)..(8): base is a locked nucleic acid
  modified_base (10)..(10): base is a locked nucleic acid
  modified_base (14)..(14): base is a locked nucleic acid
grcargaracagcatay

SEQ ID NO: 15946 - DNA, 17 bp, Artificial Sequence
  Oligonucleotide probe
  misc_binding (1)..(17): Hybridization probe for the specific detection of wild-type HIV-1 at codon 97 of the integrase gene.
  modified_base (8)..(8): base is a locked nucleic acid
  modified_base (10)..(10): base is a locked nucleic acid
  modified_base (12)..(12): base is a locked nucleic acid
grcargaracagcatay

SEQ ID NO: 15947 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (2)..(2): base is a locked nucleic acid
grcargaracagcat

SEQ ID NO: 15948 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (7)..(7): base is a locked nucleic acid
grcargaracagcat

SEQ ID NO: 15949 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (1)..(1): base is a locked nucleic acid
grcargaracagcat

SEQ ID NO: 15950 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (8)..(8): base is a locked nucleic acid
grcargaracagcat

SEQ ID NO: 15951 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (13)..(13): base is a locked nucleic acid
grcargaracagcat

SEQ ID NO: 15952 - DNA, 16 bp, Artificial Sequence
  Oligonucleotide probe
  misc_binding (1)..(16): Hybridization probe for the specific detection of wild-type HIV-1 at codon 97 of the integrase gene.
grcargaracagcata

SEQ ID NO: 15953 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (11)..(11): base is a locked nucleic acid
grcargaracagcat

SEQ ID NO: 15954 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (12)..(12): base is a locked nucleic acid
grcargaracagcat

SEQ ID NO: 15955 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (2)..(2): base is a locked nucleic acid
  modified_base (8)..(8): base is a locked nucleic acid
  modified_base (10)..(10): base is a locked nucleic acid
grcargaracagcat

SEQ ID NO: 15956 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (4)..(4): base is a locked nucleic acid
  modified_base (8)..(8): base is a locked nucleic acid
  modified_base (10)..(10): base is a locked nucleic acid
grcargaracagcat

SEQ ID NO: 15957 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (3)..(3): base is a locked nucleic acid
  modified_base (8)..(8): base is a locked nucleic acid
  modified_base (10)..(10): base is a locked nucleic acid
grcargaracagcat

SEQ ID NO: 15958 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (1)..(1): base is a locked nucleic acid
  modified_base (8)..(8): base is a locked nucleic acid
  modified_base (10)..(10): base is a locked nucleic acid
grcargaracagcat

SEQ ID NO: 15959 - DNA, 16 bp, Artificial Sequence
  Oligonucleotide probe
  misc_binding (1)..(16): Hybridization probe for the specific detection of wild-type HIV-1 at codon 97 of the integrase gene.
  modified_base (8)..(8): base is a locked nucleic acid
  modified_base (10)..(10): base is a locked nucleic acid
grcargaracagcata

SEQ ID NO: 15960 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (8)..(8): base is a locked nucleic acid
  modified_base (10)..(10): base is a locked nucleic acid
  modified_base (15)..(15): base is a locked nucleic acid
grcargaracagcat

SEQ ID NO: 15961 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (8)..(8): base is a locked nucleic acid
  modified_base (10)..(10): base is a locked nucleic acid
  modified_base (14)..(14): base is a locked nucleic acid
grcargaracagcat

SEQ ID NO: 15962 - DNA, 15 bp, Artificial Sequence
  Oligonucleotide probe
  misc_binding (1)..(15): Hybridization probe for the specific detection of wild-type HIV-1 at codon 97 of the integrase gene.
  modified_base (8)..(8): base is a locked nucleic acid
  modified_base (10)..(10): base is a locked nucleic acid
  modified_base (12)..(12): base is a locked nucleic acid
grcargaracagcat

SEQ ID NO: 15963 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (2)..(2): base is a locked nucleic acid
grcargaracagc

SEQ ID NO: 15964 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (7)..(7): base is a locked nucleic acid
grcargaracagc

SEQ ID NO: 15965 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (1)..(1): base is a locked nucleic acid
grcargaracagc

SEQ ID NO: 15966 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (8)..(8): base is a locked nucleic acid
grcargaracagc

SEQ ID NO: 15967 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (13)..(13): base is a locked nucleic acid
grcargaracagc

SEQ ID NO: 15968 - DNA, 14 bp, Artificial Sequence
  Oligonucleotide probe
  misc_binding (1)..(14): Hybridization probe for the specific detection of wild-type HIV-1 at codon 97 of the integrase gene.
grcargaracagca

SEQ ID NO: 15969 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (11)..(11): base is a locked nucleic acid
grcargaracagc

SEQ ID NO: 15970 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (12)..(12): base is a locked nucleic acid
grcargaracagc

SEQ ID NO: 15971 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (2)..(2): base is a locked nucleic acid
  modified_base (8)..(8): base is a locked nucleic acid
  modified_base (10)..(10): base is a locked nucleic acid
grcargaracagc

SEQ ID NO: 15972 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (4)..(4): base is a locked nucleic acid
  modified_base (8)..(8): base is a locked nucleic acid
  modified_base (10)..(10): base is a locked nucleic acid
grcargaracagc

SEQ ID NO: 15973 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (3)..(3): base is a locked nucleic acid
  modified_base (8)..(8): base is a locked nucleic acid
  modified_base (10)..(10): base is a locked nucleic acid
grcargaracagc

SEQ ID NO: 15974 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (1)..(1): base is a locked nucleic acid
  modified_base (8)..(8): base is a locked nucleic acid
  modified_base (10)..(10): base is a locked nucleic acid
grcargaracagc

SEQ ID NO: 15975 - DNA, 14 bp, Artificial Sequence
  Oligonucleotide probe
  misc_binding (1)..(14): Hybridization probe for the specific detection of wild-type HIV-1 at codon 97 of the integrase gene.
  modified_base (8)..(8): base is a locked nucleic acid
  modified_base (10)..(10): base is a locked nucleic acid
grcargaracagca

SEQ ID NO: 15976 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (8)..(8): base is a locked nucleic acid
  modified_base (10)..(10): base is a locked nucleic acid
grcargaracagc

SEQ ID NO: 15977 - DNA, 13 bp, Artificial Sequence
  Oligonucleotide probe
  misc_binding (1)..(13): Hybridization probe for the specific detection of wild-type HIV-1 at codon 97 of the integrase gene.
  modified_base (8)..(8): base is a locked nucleic acid
  modified_base (10)..(10): base is a locked nucleic acid
  modified_base (12)..(12): base is a locked nucleic acid
grcargaracagc

SEQ ID NO: 15978 - DNA, 19 bp, Artificial Sequence
  Oligonucleotide probe
  misc_binding (1)..(19): Hybridization probe for the specific detection of wild-type HIV-1 at codon 97 of the integrase gene.
ggrcargaracagcatayt

SEQ ID NO: 15979 - DNA, 17 bp, Artificial Sequence
  Oligonucleotide probe
  misc_binding (1)..(17): Hybridization probe for the specific detection of wild-type HIV-1 at codon 97 of the integrase gene.
grcargaracagcatay

SEQ ID NO: 15980 - DNA, 15 bp, Artificial Sequence
  Oligonucleotide probe
  misc_binding (1)..(15): Hybridization probe for the specific detection of wild-type HIV-1 at codon 97 of the integrase gene.
grcargaracagcat

SEQ ID NO: 15981 - DNA, 13 bp, Artificial Sequence
  Oligonucleotide probe
  misc_binding (1)..(13): Hybridization probe for the specific detection of wild-type HIV-1 at codon 97 of the integrase gene.
grcargaracagc

SEQ ID NO: 15982 - DNA, 15 bp, Artificial Sequence
  Oligonucleotide probe
  misc_binding (1)..(15): Hybridization probe for the specific detection of wild-type HIV-1 at codon 97 of the integrase gene.
acaggaaacwgcata

SEQ ID NO: 15983 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (2)..(2): base is a locked nucleic acid
acagayaatggymsyaayt

SEQ ID NO: 15984 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (7)..(7): base is a locked nucleic acid
acagayaatggymsyaayt

SEQ ID NO: 15985 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (4)..(4): base is a locked nucleic acid
acagayaatggymsyaayt

SEQ ID NO: 15986 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (5)..(5): base is a locked nucleic acid
acagayaatggymsyaayt

SEQ ID NO: 15987 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (16)..(16): base is a locked nucleic acid
acagayaatggymsyaayt

SEQ ID NO: 15988 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (17)..(17): base is a locked nucleic acid
acagayaatggymsyaayt

SEQ ID NO: 15989 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (11)..(11): base is a locked nucleic acid
acagayaatggymsyaayt

SEQ ID NO: 15990 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (12)..(12): base is a locked nucleic acid
acagayaatggymsyaayt

SEQ ID NO: 15991 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (2)..(2): base is a locked nucleic acid
  modified_base (9)..(9): base is a locked nucleic acid
  modified_base (11)..(11): base is a locked nucleic acid
acagayaatggymsyaayt

SEQ ID NO: 15992 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (8)..(8): base is a locked nucleic acid
  modified_base (9)..(9): base is a locked nucleic acid
  modified_base (11)..(11): base is a locked nucleic acid
acagayaatggymsyaayt

SEQ ID NO: 15993 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (3)..(3): base is a locked nucleic acid
  modified_base (9)..(9): base is a locked nucleic acid
  modified_base (11)..(11): base is a locked nucleic acid
acagayaatggymsyaayt

SEQ ID NO: 15994 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (7)..(7): base is a locked nucleic acid
  modified_base (9)..(9): base is a locked nucleic acid
  modified_base (11)..(11): base is a locked nucleic acid
acagayaatggymsyaayt

SEQ ID NO: 15995 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (9)..(9): base is a locked nucleic acid
  modified_base (11)..(11): base is a locked nucleic acid
  modified_base (12)..(12): base is a locked nucleic acid
acagayaatggymsyaayt

SEQ ID NO: 15996 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (9)..(9): base is a locked nucleic acid
  modified_base (11)..(11): base is a locked nucleic acid
  modified_base (15)..(15): base is a locked nucleic acid
acagayaatggymsyaayt

SEQ ID NO: 15997 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (9)..(9): base is a locked nucleic acid
  modified_base (11)..(11): base is a locked nucleic acid
  modified_base (18)..(18): base is a locked nucleic acid
acagayaatggymsyaayt

SEQ ID NO: 15998 - DNA, 19 bp, Artificial Sequence
  Oligonucleotide probe
  misc_binding (1)..(19): Hybridization probe for the specific detection of wild-type HIV-1 at codon 118 of the integrase gene.
  modified_base (9)..(9): base is a locked nucleic acid
  modified_base (11)..(11): base is a locked nucleic acid
  modified_base (14)..(14): base is a locked nucleic acid
acagayaatggymsyaayt

SEQ ID NO: 15999 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (1)..(1): base is a locked nucleic acid
cagayaatggymsyaay

SEQ ID NO: 16000 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (6)..(6): base is a locked nucleic acid
cagayaatggymsyaay

SEQ ID NO: 16001 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (3)..(3): base is a locked nucleic acid
cagayaatggymsyaay

SEQ ID NO: 16002 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (4)..(4): base is a locked nucleic acid
cagayaatggymsyaay

SEQ ID NO: 16003 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (15)..(15): base is a locked nucleic acid
cagayaatggymsyaay

SEQ ID NO: 16004 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (16)..(16): base is a locked nucleic acid
cagayaatggymsyaay

SEQ ID NO: 16005 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (10)..(10): base is a locked nucleic acid
cagayaatggymsyaay

SEQ ID NO: 16006 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (11)..(11): base is a locked nucleic acid
cagayaatggymsyaay

SEQ ID NO: 16007 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (1)..(1): base is a locked nucleic acid
  modified_base (8)..(8): base is a locked nucleic acid
  modified_base (10)..(10): base is a locked nucleic acid
cagayaatggymsyaay

SEQ ID NO: 16008 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (7)..(7): base is a locked nucleic acid
  modified_base (8)..(8): base is a locked nucleic acid
  modified_base (10)..(10): base is a locked nucleic acid
cagayaatggymsyaay

SEQ ID NO: 16009 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (2)..(2): base is a locked nucleic acid
  modified_base (8)..(8): base is a locked nucleic acid
  modified_base (10)..(10): base is a locked nucleic acid
cagayaatggymsyaay

SEQ ID NO: 16010 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (6)..(6): base is a locked nucleic acid
  modified_base (8)..(8): base is a locked nucleic acid
  modified_base (10)..(10): base is a locked nucleic acid
cagayaatggymsyaay

SEQ ID NO: 16011 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (11)..(11): base is a locked nucleic acid
cagayaatggymsyaay

SEQ ID NO: 16012 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (14)..(14): base is a locked nucleic acid
cagayaatggymsyaay

SEQ ID NO: 16013 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (17)..(17): base is a locked nucleic acid
cagayaatggymsyaay

SEQ ID NO: 16014 - DNA, 17 bp, Artificial Sequence
  Oligonucleotide probe
  misc_binding (1)..(17): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (13)..(13): base is a locked nucleic acid
cagayaatggymsyaay

SEQ ID NO: 16015 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (1)..(1): base is a locked nucleic acid
cagayaatggymsya

SEQ ID NO: 16016 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (6)..(6): base is a locked nucleic acid
cagayaatggymsya

SEQ ID NO: 16017 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (3)..(3): base is a locked nucleic acid
cagayaatggymsya

SEQ ID NO: 16018 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (4)..(4): base is a locked nucleic acid
cagayaatggymsya

SEQ ID NO: 16019 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (15)..(15): base is a locked nucleic acid
cagayaatggymsya

SEQ ID NO: 16020 - DNA, 15 bp, Artificial Sequence
  Oligonucleotide probe
  misc_binding (1)..(15): Hybridization probe for the specific detection of wild-type HIV-1 at codon 118 of the integrase gene.
cagayaatggymsya

SEQ ID NO: 16021 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (10)..(10): base is a locked nucleic acid
cagayaatggymsya

SEQ ID NO: 16022 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (11)..(11): base is a locked nucleic acid
cagayaatggymsya

SEQ ID NO: 16023 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (1)..(1): base is a locked nucleic acid
  modified_base (8)..(8): base is a locked nucleic acid
  modified_base (10)..(10): base is a locked nucleic acid
cagayaatggymsya

SEQ ID NO: 16024 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (7)..(7): base is a locked nucleic acid
  modified_base (8)..(8): base is a locked nucleic acid
  modified_base (10)..(10): base is a locked nucleic acid
cagayaatggymsya

SEQ ID NO: 16025 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (2)..(2): base is a locked nucleic acid
  modified_base (8)..(8): base is a locked nucleic acid
  modified_base (10)..(10): base is a locked nucleic acid
cagayaatggymsya

SEQ ID NO: 16026 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (6)..(6): base is a locked nucleic acid
  modified_base (8)..(8): base is a locked nucleic acid
  modified_base (10)..(10): base is a locked nucleic acid
cagayaatggymsya

SEQ ID NO: 16027 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (11)..(11): base is a locked nucleic acid
cagayaatggymsya

SEQ ID NO: 16028 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (14)..(14): base is a locked nucleic acid
cagayaatggymsya

SEQ ID NO: 16029 - DNA, 16 bp, Artificial Sequence
  Oligonucleotide probe
  misc_binding (1)..(16): Hybridization probe for the specific detection of wild-type HIV-1 at codon 118 of the integrase gene.
  modified_base (8)..(8): base is a locked nucleic acid
  modified_base (10)..(10): base is a locked nucleic acid
cagayaatggymsyaa

SEQ ID NO: 16030 - DNA, 15 bp, Artificial Sequence
  Oligonucleotide probe
  misc_binding (1)..(15): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (13)..(13): base is a locked nucleic acid
cagayaatggymsya

SEQ ID NO: 16031 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (1)..(1): base is a locked nucleic acid
cagayaatggyms

SEQ ID NO: 16032 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (6)..(6): base is a locked nucleic acid
cagayaatggyms

SEQ ID NO: 16033 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (3)..(3): base is a locked nucleic acid
cagayaatggyms

SEQ ID NO: 16034 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (4)..(4): base is a locked nucleic acid
cagayaatggyms

SEQ ID NO: 16035 - DNA, 14 bp, Artificial Sequence
  Oligonucleotide probe
  misc_binding (1)..(14): Hybridization probe for the specific detection of wild-type HIV-1 at codon 118 of the integrase gene.
cagayaatggymsy

SEQ ID NO: 16036 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (10)..(10): base is a locked nucleic acid
cagayaatggyms

SEQ ID NO: 16037 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (11)..(11): base is a locked nucleic acid
cagayaatggyms

SEQ ID NO: 16038 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (1)..(1): base is a locked nucleic acid
  modified_base (8)..(8): base is a locked nucleic acid
  modified_base (10)..(10): base is a locked nucleic acid
cagayaatggyms

SEQ ID NO: 16039 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (7)..(7): base is a locked nucleic acid
  modified_base (8)..(8): base is a locked nucleic acid
  modified_base (10)..(10): base is a locked nucleic acid
cagayaatggyms

SEQ ID NO: 16040 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (2)..(2): base is a locked nucleic acid
  modified_base (8)..(8): base is a locked nucleic acid
  modified_base (10)..(10): base is a locked nucleic acid
cagayaatggyms

SEQ ID NO: 16041 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (6)..(6): base is a locked nucleic acid
  modified_base (8)..(8): base is a locked nucleic acid
  modified_base (10)..(10): base is a locked nucleic acid
cagayaatggyms

SEQ ID NO: 16042 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (11)..(11): base is a locked nucleic acid
cagayaatggyms

SEQ ID NO: 16043 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (8)..(8): base is a locked nucleic acid
  modified_base (10)..(10): base is a locked nucleic acid
cagayaatggyms

SEQ ID NO: 16044 - DNA, 14 bp, Artificial Sequence
  Oligonucleotide probe
  misc_binding (1)..(14): Hybridization probe for the specific detection of wild-type HIV-1 at codon 118 of the integrase gene.
  modified_base (8)..(8): base is a locked nucleic acid
  modified_base (10)..(10): base is a locked nucleic acid
cagayaatggymsy

SEQ ID NO: 16045 - DNA, 13 bp, Artificial Sequence
  Oligonucleotide probe
  misc_binding (1)..(13): Hybridization probe for the specific detection of wild-type HIV-1 at codon 118 of the integrase gene.
  modified_base (8)..(8): base is a locked nucleic acid
  modified_base (10)..(10): base is a locked nucleic acid
  modified_base (13)..(13): base is a locked nucleic acid
cagayaatggyms

SEQ ID NO: 16046 - DNA, 19 bp, Artificial Sequence
  Oligonucleotide probe
  misc_binding (1)..(19): Hybridization probe for the specific detection of wild-type HIV-1 at codon 118 of the integrase gene.
acagayaatggymsyaayt

SEQ ID NO: 16047 - DNA, 17 bp, Artificial Sequence
  Oligonucleotide probe
  misc_binding (1)..(17): Hybridization probe for the specific detection of wild-type HIV-1 at codon 118 of the integrase gene.
cagayaatggymsyaay

SEQ ID NO: 16048 - DNA, 15 bp, Artificial Sequence
  Oligonucleotide probe
  misc_binding (1)..(15): Hybridization probe for the specific detection of wild-type HIV-1 at codon 118 of the integrase gene.
cagayaatggymsya

SEQ ID NO: 16049 - DNA, 16 bp, Artificial Sequence
  Oligonucleotide probe
  misc_binding (1)..(16): Hybridization probe for the specific detection of wild-type HIV-1 at codon 118 of the integrase gene.
cagayaatggymsyaa

SEQ ID NO: 16050 - DNA, 13 bp, Artificial Sequence
  Oligonucleotide probe
  misc_binding (1)..(13): Hybridization probe for the specific detection of wild-type HIV-1 at codon 118 of the integrase gene.
cagayaatggyms

SEQ ID NO: 16051 - DNA, 15 bp, Artificial Sequence
  Oligonucleotide probe
  misc_binding (1)..(15): Hybridization probe for the specific detection of wild-type HIV-1 at codon 118 of the integrase gene.
  misc_feature (10)..(10): n is a, c, g, or t
agacaatggnagcaa

SEQ ID NO: 16052 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (8)..(8): base is a locked nucleic acid
gymsyaayttyacyagyrv

SEQ ID NO: 16053 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (2)..(2): base is a locked nucleic acid
gymsyaayttyacyagyrv

SEQ ID NO: 16054 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (3)..(3): base is a locked nucleic acid
gymsyaayttyacyagyrv

SEQ ID NO: 16055 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (5)..(5): base is a locked nucleic acid
gymsyaayttyacyagyrv

SEQ ID NO: 16056 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (15)..(15): base is a locked nucleic acid
gymsyaayttyacyagyrv

SEQ ID NO: 16057 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (13)..(13): base is a locked nucleic acid
gymsyaayttyacyagyrv

SEQ ID NO: 16058 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (12)..(12): base is a locked nucleic acid
gymsyaayttyacyagyrv

SEQ ID NO: 16059 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (19)..(19): base is a locked nucleic acid
gymsyaayttyacyagyrv

SEQ ID NO: 16060 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (8)..(8): base is a locked nucleic acid
  modified_base (9)..(9): base is a locked nucleic acid
  modified_base (11)..(11): base is a locked nucleic acid
gymsyaayttyacyagyrv

SEQ ID NO: 16061 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (5)..(5): base is a locked nucleic acid
  modified_base (9)..(9): base is a locked nucleic acid
  modified_base (11)..(11): base is a locked nucleic acid
gymsyaayttyacyagyrv

SEQ ID NO: 16062 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (2)..(2): base is a locked nucleic acid
  modified_base (9)..(9): base is a locked nucleic acid
  modified_base (11)..(11): base is a locked nucleic acid
gymsyaayttyacyagyrv

SEQ ID NO: 16063 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (7)..(7): base is a locked nucleic acid
  modified_base (9)..(9): base is a locked nucleic acid
  modified_base (11)..(11): base is a locked nucleic acid
gymsyaayttyacyagyrv

SEQ ID NO: 16064 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (9)..(9): base is a locked nucleic acid
  modified_base (11)..(11): base is a locked nucleic acid
  modified_base (15)..(15): base is a locked nucleic acid
gymsyaayttyacyagyrv

SEQ ID NO: 16065 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (9)..(9): base is a locked nucleic acid
  modified_base (11)..(11): base is a locked nucleic acid
  modified_base (19)..(19): base is a locked nucleic acid
gymsyaayttyacyagyrv

SEQ ID NO: 16066 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (9)..(9): base is a locked nucleic acid
  modified_base (11)..(11): base is a locked nucleic acid
  modified_base (14)..(14): base is a locked nucleic acid
gymsyaayttyacyagyrv

SEQ ID NO: 16067 - DNA, 19 bp, Artificial Sequence
  Oligonucleotide probe
  misc_binding (1)..(19): Hybridization probe for the specific detection of wild-type HIV-1 at codon 121 of the integrase gene.
  modified_base (9)..(9): base is a locked nucleic acid
  modified_base (11)..(11): base is a locked nucleic acid
  modified_base (13)..(13): base is a locked nucleic acid
gymsyaayttyacyagyrv

SEQ ID NO: 16068 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (7)..(7): base is a locked nucleic acid
ymsyaayttyacyagyr

SEQ ID NO: 16069 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (1)..(1): base is a locked nucleic acid
ymsyaayttyacyagyr

SEQ ID NO: 16070 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (2)..(2): base is a locked nucleic acid
ymsyaayttyacyagyr

SEQ ID NO: 16071 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (4)..(4): base is a locked nucleic acid
ymsyaayttyacyagyr

SEQ ID NO: 16072 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (14)..(14): base is a locked nucleic acid
ymsyaayttyacyagyr

SEQ ID NO: 16073 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (12)..(12): base is a locked nucleic acid
ymsyaayttyacyagyr

SEQ ID NO: 16074 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (11)..(11): base is a locked nucleic acid
ymsyaayttyacyagyr

SEQ ID NO: 16075 - DNA, 17 bp, Artificial Sequence
  Oligonucleotide probe
  misc_binding (1)..(17): Hybridization probe for the specific detection of wild-type HIV-1 at codon 121 of the integrase gene.
ymsyaayttyacyagyr

SEQ ID NO: 16076 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (7)..(7): base is a locked nucleic acid
  modified_base (8)..(8): base is a locked nucleic acid
  modified_base (10)..(10): base is a locked nucleic acid
ymsyaayttyacyagyr

SEQ ID NO: 16077 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (4)..(4): base is a locked nucleic acid
  modified_base (8)..(8): base is a locked nucleic acid
  modified_base (10)..(10): base is a locked nucleic acid
ymsyaayttyacyagyr

SEQ ID NO: 16078 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (1)..(1): base is a locked nucleic acid
  modified_base (8)..(8): base is a locked nucleic acid
  modified_base (10)..(10): base is a locked nucleic acid
ymsyaayttyacyagyr

SEQ ID NO: 16079 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (6)..(6): base is a locked nucleic acid
  modified_base (8)..(8): base is a locked nucleic acid
  modified_base (10)..(10): base is a locked nucleic acid
ymsyaayttyacyagyr

SEQ ID NO: 16080 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (14)..(14): base is a locked nucleic acid
ymsyaayttyacyagyr

SEQ ID NO: 16081 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (8)..(8): base is a locked nucleic acid
  modified_base (10)..(10): base is a locked nucleic acid
ymsyaayttyacyagyr

SEQ ID NO: 16082 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (13)..(13): base is a locked nucleic acid
ymsyaayttyacyagyr

SEQ ID NO: 16083 - DNA, 17 bp, Artificial Sequence
  Oligonucleotide probe
  misc_binding (1)..(17): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (12)..(12): base is a locked nucleic acid
ymsyaayttyacyagyr

SEQ ID NO: 16084 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (7)..(7): base is a locked nucleic acid
ymsyaayttyacyag

SEQ ID NO: 16085 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (1)..(1): base is a locked nucleic acid
ymsyaayttyacyag

SEQ ID NO: 16086 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (2)..(2): base is a locked nucleic acid
ymsyaayttyacyag

SEQ ID NO: 16087 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (4)..(4): base is a locked nucleic acid
ymsyaayttyacyag

SEQ ID NO: 16088 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (14)..(14): base is a locked nucleic acid
ymsyaayttyacyag

SEQ ID NO: 16089 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (12)..(12): base is a locked nucleic acid
ymsyaayttyacyag

SEQ ID NO: 16090 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (11)..(11): base is a locked nucleic acid
ymsyaayttyacyag

SEQ ID NO: 16091 - DNA, 16 bp, Artificial Sequence
  Oligonucleotide probe
  misc_binding (1)..(16): Hybridization probe for the specific detection of wild-type HIV-1 at codon 121 of the integrase gene.
ymsyaayttyacyagy

SEQ ID NO: 16092 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (7)..(7): base is a locked nucleic acid
  modified_base (8)..(8): base is a locked nucleic acid
  modified_base (10)..(10): base is a locked nucleic acid
ymsyaayttyacyag

SEQ ID NO: 16093 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (4)..(4): base is a locked nucleic acid
  modified_base (8)..(8): base is a locked nucleic acid
  modified_base (10)..(10): base is a locked nucleic acid
ymsyaayttyacyag

SEQ ID NO: 16094 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (1)..(1): base is a locked nucleic acid
  modified_base (8)..(8): base is a locked nucleic acid
  modified_base (10)..(10): base is a locked nucleic acid
ymsyaayttyacyag

SEQ ID NO: 16095 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (6)..(6): base is a locked nucleic acid
  modified_base (8)..(8): base is a locked nucleic acid
  modified_base (10)..(10): base is a locked nucleic acid
ymsyaayttyacyag

SEQ ID NO: 16096 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (14)..(14): base is a locked nucleic acid
ymsyaayttyacyag

SEQ ID NO: 16097 - DNA, 16 bp, Artificial Sequence
  Oligonucleotide probe
  misc_binding (1)..(16): Hybridization probe for the specific detection of wild-type HIV-1 at codon 121 of the integrase gene.
  modified_base (8)..(8): base is a locked nucleic acid
  modified_base (10)..(10): base is a locked nucleic acid
ymsyaayttyacyagy

SEQ ID NO: 16098 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (13)..(13): base is a locked nucleic acid
ymsyaayttyacyag

SEQ ID NO: 16099 - DNA, 15 bp, Artificial Sequence
  Oligonucleotide probe
  misc_binding (1)..(15): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (12)..(12): base is a locked nucleic acid
ymsyaayttyacyag

SEQ ID NO: 16100 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (7)..(7): base is a locked nucleic acid
ymsyaayttyacy

SEQ ID NO: 16101 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (1)..(1): base is a locked nucleic acid
ymsyaayttyacy

SEQ ID NO: 16102 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (2)..(2): base is a locked nucleic acid
ymsyaayttyacy

SEQ ID NO: 16103 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (4)..(4): base is a locked nucleic acid
ymsyaayttyacy

SEQ ID NO: 16104 - DNA, 13 bp, Artificial Sequence
  Oligonucleotide probe
  misc_binding (1)..(13): Hybridization probe for the specific detection of wild-type HIV-1 at codon 121 of the integrase gene.
ymsyaayttyacy

SEQ ID NO: 16105 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (12)..(12): base is a locked nucleic acid
ymsyaayttyacy

SEQ ID NO: 16106 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (11)..(11): base is a locked nucleic acid
ymsyaayttyacy

SEQ ID NO: 16107 - DNA, 14 bp, Artificial Sequence
  Oligonucleotide probe
  misc_binding (1)..(14): Hybridization probe for the specific detection of wild-type HIV-1 at codon 121 of the integrase gene.
ymsyaayttyacya

SEQ ID NO: 16108 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (7)..(7): base is a locked nucleic acid
  modified_base (8)..(8): base is a locked nucleic acid
  modified_base (10)..(10): base is a locked nucleic acid
ymsyaayttyacy

SEQ ID NO: 16109 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (4)..(4): base is a locked nucleic acid
  modified_base (8)..(8): base is a locked nucleic acid
  modified_base (10)..(10): base is a locked nucleic acid
ymsyaayttyacy

SEQ ID NO: 16110 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (1)..(1): base is a locked nucleic acid
  modified_base (8)..(8): base is a locked nucleic acid
  modified_base (10)..(10): base is a locked nucleic acid
ymsyaayttyacy

SEQ ID NO: 16111 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (6)..(6): base is a locked nucleic acid
  modified_base (8)..(8): base is a locked nucleic acid
  modified_base (10)..(10): base is a locked nucleic acid
ymsyaayttyacy

SEQ ID NO: 16112 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (8)..(8): base is a locked nucleic acid
  modified_base (10)..(10): base is a locked nucleic acid
ymsyaayttyacy

SEQ ID NO: 16113 - DNA, 14 bp, Artificial Sequence
  Oligonucleotide probe
  misc_binding (1)..(14): Hybridization probe for the specific detection of wild-type HIV-1 at codon 121 of the integrase gene.
  modified_base (8)..(8): base is a locked nucleic acid
  modified_base (10)..(10): base is a locked nucleic acid
ymsyaayttyacya

SEQ ID NO: 16114 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (13)..(13): base is a locked nucleic acid
ymsyaayttyacy

SEQ ID NO: 16115 - DNA, 13 bp, Artificial Sequence
  Oligonucleotide probe
  misc_binding (1)..(13): Hybridization probe for the specific detection of wild-type HIV-1 at codon 121 of the integrase gene.
  modified_base (8)..(8): base is a locked nucleic acid
  modified_base (10)..(10): base is a locked nucleic acid
  modified_base (12)..(12): base is a locked nucleic acid
ymsyaayttyacy

SEQ ID NO: 16116 - DNA, 19 bp, Artificial Sequence
  Oligonucleotide probe
  misc_binding (1)..(19): Hybridization probe for the specific detection of wild-type HIV-1 at codon 121 of the integrase gene.
gymsyaayttyacyagyrv

SEQ ID NO: 16117 - DNA, 17 bp, Artificial Sequence
  Oligonucleotide probe
  misc_binding (1)..(17): Hybridization probe for the specific detection of wild-type HIV-1 at codon 121 of the integrase gene.
ymsyaayttyacyagyr

SEQ ID NO: 16118 - DNA, 15 bp, Artificial Sequence
  Oligonucleotide probe
  misc_binding (1)..(15): Hybridization probe for the specific detection of wild-type HIV-1 at codon 121 of the integrase gene.
ymsyaayttyacyag

SEQ ID NO: 16119 - DNA, 13 bp, Artificial Sequence
  Oligonucleotide probe
  misc_binding (1)..(13): Hybridization probe for the specific detection of wild-type HIV-1 at codon 121 of the integrase gene.
ymsyaayttyacy

SEQ ID NO: 16120 - DNA, 15 bp, Artificial Sequence
  Oligonucleotide probe
  misc_binding (1)..(15): Hybridization probe for the specific detection of wild-type HIV-1 at codon 121 of the integrase gene.
agcaatttyaccagt

SEQ ID NO: 16121 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (8)..(8): base is a locked nucleic acid
tcmmrcargaatttggvat

SEQ ID NO: 16122 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (4)..(4): base is a locked nucleic acid
tcmmrcargaatttggvat

SEQ ID NO: 16123 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (3)..(3): base is a locked nucleic acid
tcmmrcargaatttggvat

SEQ ID NO: 16124 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
tcmmrcargaatttggvat

SEQ ID NO: 16125 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (13)..(13): base is a locked nucleic acid
tcmmrcargaatttggvat

SEQ ID NO: 16126 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (19)..(19): base is a locked nucleic acid
tcmmrcargaatttggvat

SEQ ID NO: 16127 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (11)..(11): base is a locked nucleic acid
tcmmrcargaatttggvat

SEQ ID NO: 16128 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (18)..(18): base is a locked nucleic acid
tcmmrcargaatttggvat

SEQ ID NO: 16129 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (3)..(3): base is a locked nucleic acid
  modified_base (9)..(9): base is a locked nucleic acid
  modified_base (11)..(11): base is a locked nucleic acid
tcmmrcargaatttggvat

SEQ ID NO: 16130 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (7)..(7): base is a locked nucleic acid
  modified_base (9)..(9): base is a locked nucleic acid
  modified_base (11)..(11): base is a locked nucleic acid
tcmmrcargaatttggvat

SEQ ID NO: 16131 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (4)..(4): base is a locked nucleic acid
  modified_base (9)..(9): base is a locked nucleic acid
  modified_base (11)..(11): base is a locked nucleic acid
tcmmrcargaatttggvat

SEQ ID NO: 16132 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (5)..(5): base is a locked nucleic acid
  modified_base (9)..(9): base is a locked nucleic acid
  modified_base (11)..(11): base is a locked nucleic acid
tcmmrcargaatttggvat

SEQ ID NO: 16133 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (19)..(19): base is a locked nucleic acid
tcmmrcargaatttggvat

SEQ ID NO: 16134 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (14)..(14): base is a locked nucleic acid
tcmmrcargaatttggvat

SEQ ID NO: 16135 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (15)..(15): base is a locked nucleic acid
tcmmrcargaatttggvat

SEQ ID NO: 16136 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (12)..(12): base is a locked nucleic acid
tcmmrcargaatttggvat

SEQ ID NO: 16137 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (4)..(4): base is a locked nucleic acid
rtcmmrcargaatttggva

SEQ ID NO: 16138 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (2)..(2): base is a locked nucleic acid
rtcmmrcargaatttggva

SEQ ID NO: 16139 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (5)..(5): base is a locked nucleic acid
rtcmmrcargaatttggva

SEQ ID NO: 16140 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (8)..(8): base is a locked nucleic acid
rtcmmrcargaatttggva

SEQ ID NO: 16141 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (19)..(19): base is a locked nucleic acid
rtcmmrcargaatttggva

SEQ ID NO: 16142 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (11)..(11): base is a locked nucleic acid
rtcmmrcargaatttggva

SEQ ID NO: 16143 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (14)..(14): base is a locked nucleic acid
rtcmmrcargaatttggva

SEQ ID NO: 16144 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (12)..(12): base is a locked nucleic acid
rtcmmrcargaatttggva

SEQ ID NO: 16145 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (8)..(8): base is a locked nucleic acid
  modified_base (9)..(9): base is a locked nucleic acid
  modified_base (11)..(11): base is a locked nucleic acid
rtcmmrcargaatttggva

SEQ ID NO: 16146 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (6)..(6): base is a locked nucleic acid
  modified_base (9)..(9): base is a locked nucleic acid
  modified_base (11)..(11): base is a locked nucleic acid
rtcmmrcargaatttggva

SEQ ID NO: 16147 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (3)..(3): base is a locked nucleic acid
  modified_base (9)..(9): base is a locked nucleic acid
  modified_base (11)..(11): base is a locked nucleic acid
rtcmmrcargaatttggva

SEQ ID NO: 16148 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (4)..(4): base is a locked nucleic acid
  modified_base (9)..(9): base is a locked nucleic acid
  modified_base (11)..(11): base is a locked nucleic acid
rtcmmrcargaatttggva

SEQ ID NO: 16149 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (14)..(14): base is a locked nucleic acid
rtcmmrcargaatttggva

SEQ ID NO: 16150 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (12)..(12): base is a locked nucleic acid
rtcmmrcargaatttggva

SEQ ID NO: 16151 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (18)..(18): base is a locked nucleic acid
rtcmmrcargaatttggva

SEQ ID NO: 16152 - DNA, 19 bp, Artificial Sequence
  Oligonucleotide probe
  misc_binding (1)..(19): Hybridization probe for the specific detection of wild-type HIV-1 at codon 138 of the integrase gene.
  modified_base (9)..(9): base is a locked nucleic acid
  modified_base (11)..(11): base is a locked nucleic acid
  modified_base (13)..(13): base is a locked nucleic acid
rtcmmrcargaatttggva

SEQ ID NO: 16153 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (7)..(7): base is a locked nucleic acid
cmmrcargaatttggva

SEQ ID NO: 16154 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (3)..(3): base is a locked nucleic acid
cmmrcargaatttggva

SEQ ID NO: 16155 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (2)..(2): base is a locked nucleic acid
cmmrcargaatttggva

SEQ ID NO: 16156 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
cmmrcargaatttggva

SEQ ID NO: 16157 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (12)..(12): base is a locked nucleic acid
cmmrcargaatttggva

SEQ ID NO: 16158 - DNA, 17 bp, Artificial Sequence
  Oligonucleotide probe
  misc_binding (1)..(17): Hybridization probe for the specific detection of wild-type HIV-1 at codon 138 of the integrase gene.
cmmrcargaatttggva

SEQ ID NO: 16159 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (10)..(10): base is a locked nucleic acid
cmmrcargaatttggva

SEQ ID NO: 16160 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (17)..(17): base is a locked nucleic acid
cmmrcargaatttggva

SEQ ID NO: 16161 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (2)..(2): base is a locked nucleic acid
  modified_base (8)..(8): base is a locked nucleic acid
  modified_base (10)..(10): base is a locked nucleic acid
cmmrcargaatttggva

SEQ ID NO: 16162 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (6)..(6): base is a locked nucleic acid
  modified_base (8)..(8): base is a locked nucleic acid
  modified_base (10)..(10): base is a locked nucleic acid
cmmrcargaatttggva

SEQ ID NO: 16163 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (3)..(3): base is a locked nucleic acid
  modified_base (8)..(8): base is a locked nucleic acid
  modified_base (10)..(10): base is a locked nucleic acid
cmmrcargaatttggva

SEQ ID NO: 16164 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (4)..(4): base is a locked nucleic acid
  modified_base (8)..(8): base is a locked nucleic acid
  modified_base (10)..(10): base is a locked nucleic acid
cmmrcargaatttggva

SEQ ID NO: 16165 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
cmmrcargaatttggva

SEQ ID NO: 16166 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (13)..(13): base is a locked nucleic acid
cmmrcargaatttggva

SEQ ID NO: 16167 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (14)..(14): base is a locked nucleic acid
cmmrcargaatttggva

SEQ ID NO: 16168 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (11)..(11): base is a locked nucleic acid
cmmrcargaatttggva

SEQ ID NO: 16169 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (3)..(3): base is a locked nucleic acid
tcmmrcargaatttggv

SEQ ID NO: 16170 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (1)..(1): base is a locked nucleic acid
tcmmrcargaatttggv

SEQ ID NO: 16171 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (4)..(4): base is a locked nucleic acid
tcmmrcargaatttggv

SEQ ID NO: 16172 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (7)..(7): base is a locked nucleic acid
tcmmrcargaatttggv

SEQ ID NO: 16173 - DNA, 17 bp, Artificial Sequence
  Oligonucleotide probe
  misc_binding (1)..(17): Hybridization probe for the specific detection of wild-type HIV-1 at codon 138 of the integrase gene.
tcmmrcargaatttggv

SEQ ID NO: 16174 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (10)..(10): base is a locked nucleic acid
tcmmrcargaatttggv

SEQ ID NO: 16175 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (13)..(13): base is a locked nucleic acid
tcmmrcargaatttggv

SEQ ID NO: 16176 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (11)..(11): base is a locked nucleic acid
tcmmrcargaatttggv

SEQ ID NO: 16177 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (7)..(7): base is a locked nucleic acid
  modified_base (8)..(8): base is a locked nucleic acid
  modified_base (10)..(10): base is a locked nucleic acid
tcmmrcargaatttggv

SEQ ID NO: 16178 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (5)..(5): base is a locked nucleic acid
  modified_base (8)..(8): base is a locked nucleic acid
  modified_base (10)..(10): base is a locked nucleic acid
tcmmrcargaatttggv

SEQ ID NO: 16179 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (2)..(2): base is a locked nucleic acid
  modified_base (8)..(8): base is a locked nucleic acid
  modified_base (10)..(10): base is a locked nucleic acid
tcmmrcargaatttggv

SEQ ID NO: 16180 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (3)..(3): base is a locked nucleic acid
  modified_base (8)..(8): base is a locked nucleic acid
  modified_base (10)..(10): base is a locked nucleic acid
tcmmrcargaatttggv

SEQ ID NO: 16181 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (13)..(13): base is a locked nucleic acid
tcmmrcargaatttggv

SEQ ID NO: 16182 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (11)..(11): base is a locked nucleic acid
tcmmrcargaatttggv

SEQ ID NO: 16183 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (17)..(17): base is a locked nucleic acid
tcmmrcargaatttggv

SEQ ID NO: 16184 - DNA, 17 bp, Artificial Sequence
  Oligonucleotide probe
  misc_binding (1)..(17): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (12)..(12): base is a locked nucleic acid
tcmmrcargaatttggv

SEQ ID NO: 16185 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (7)..(7): base is a locked nucleic acid
cmmrcargaatttgg

SEQ ID NO: 16186 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (3)..(3): base is a locked nucleic acid
cmmrcargaatttgg

SEQ ID NO: 16187 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (2)..(2): base is a locked nucleic acid
cmmrcargaatttgg

SEQ ID NO: 16188 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (8)..(8): base is a locked nucleic acid
cmmrcargaatttgg

SEQ ID NO: 16189 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (12)..(12): base is a locked nucleic acid
cmmrcargaatttgg

SEQ ID NO: 16190 - DNA, 16 bp, Artificial Sequence
  Oligonucleotide probe
  misc_binding (1)..(16): Hybridization probe for the specific detection of wild-type HIV-1 at codon 138 of the integrase gene.
cmmrcargaatttggv

SEQ ID NO: 16191 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (10)..(10): base is a locked nucleic acid
cmmrcargaatttgg

SEQ ID NO: 16192 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (2)..(2): base is a locked nucleic acid
  modified_base (8)..(8): base is a locked nucleic acid
  modified_base (10)..(10): base is a locked nucleic acid
cmmrcargaatttgg

SEQ ID NO: 16193 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (6)..(6): base is a locked nucleic acid
  modified_base (8)..(8): base is a locked nucleic acid
  modified_base (10)..(10): base is a locked nucleic acid
cmmrcargaatttgg

SEQ ID NO: 16194 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (3)..(3): base is a locked nucleic acid
  modified_base (8)..(8): base is a locked nucleic acid
  modified_base (10)..(10): base is a locked nucleic acid
cmmrcargaatttgg

SEQ ID NO: 16195 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (4)..(4): base is a locked nucleic acid
  modified_base (8)..(8): base is a locked nucleic acid
  modified_base (10)..(10): base is a locked nucleic acid
cmmrcargaatttgg

SEQ ID NO: 16196 - DNA, 16 bp, Artificial Sequence
  Oligonucleotide probe
  misc_binding (1)..(16): Hybridization probe for the specific detection of wild-type HIV-1 at codon 138 of the integrase gene.
  modified_base (8)..(8): base is a locked nucleic acid
  modified_base (10)..(10): base is a locked nucleic acid
cmmrcargaatttggv

SEQ ID NO: 16197 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (13)..(13): base is a locked nucleic acid
cmmrcargaatttgg

SEQ ID NO: 16198 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (14)..(14): base is a locked nucleic acid
cmmrcargaatttgg

SEQ ID NO: 16199 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (11)..(11): base is a locked nucleic acid
cmmrcargaatttgg

SEQ ID NO: 16200 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (3)..(3): base is a locked nucleic acid
tcmmrcargaatttg

SEQ ID NO: 16201 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (1)..(1): base is a locked nucleic acid
tcmmrcargaatttg

SEQ ID NO: 16202 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (4)..(4): base is a locked nucleic acid
tcmmrcargaatttg

SEQ ID NO: 16203 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (7)..(7): base is a locked nucleic acid
tcmmrcargaatttg

SEQ ID NO: 16204 - DNA, 16 bp, Artificial Sequence
  Oligonucleotide probe
  misc_binding (1)..(16): Hybridization probe for the specific detection of wild-type HIV-1 at codon 138 of the integrase gene.
tcmmrcargaatttgg

SEQ ID NO: 16205 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (10)..(10): base is a locked nucleic acid
tcmmrcargaatttg

SEQ ID NO: 16206 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (13)..(13): base is a locked nucleic acid
tcmmrcargaatttg

SEQ ID NO: 16207 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (11)..(11): base is a locked nucleic acid
tcmmrcargaatttg

SEQ ID NO: 16208 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (7)..(7): base is a locked nucleic acid
  modified_base (8)..(8): base is a locked nucleic acid
  modified_base (10)..(10): base is a locked nucleic acid
tcmmrcargaatttg

SEQ ID NO: 16209 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (5)..(5): base is a locked nucleic acid
  modified_base (8)..(8): base is a locked nucleic acid
  modified_base (10)..(10): base is a locked nucleic acid
tcmmrcargaatttg

SEQ ID NO: 16210 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (2)..(2): base is a locked nucleic acid
  modified_base (8)..(8): base is a locked nucleic acid
  modified_base (10)..(10): base is a locked nucleic acid
tcmmrcargaatttg

SEQ ID NO: 16211 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (3)..(3): base is a locked nucleic acid
  modified_base (8)..(8): base is a locked nucleic acid
  modified_base (10)..(10): base is a locked nucleic acid
tcmmrcargaatttg

SEQ ID NO: 16212 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (13)..(13): base is a locked nucleic acid
tcmmrcargaatttg

SEQ ID NO: 16213 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (11)..(11): base is a locked nucleic acid
tcmmrcargaatttg

SEQ ID NO: 16214 - DNA, 16 bp, Artificial Sequence
  Oligonucleotide probe
  misc_binding (1)..(16): Hybridization probe for the specific detection of wild-type HIV-1 at codon 138 of the integrase gene.
  modified_base (8)..(8): base is a locked nucleic acid
  modified_base (10)..(10): base is a locked nucleic acid
tcmmrcargaatttgg

SEQ ID NO: 16215 - DNA, 15 bp, Artificial Sequence
  Oligonucleotide probe
  misc_binding (1)..(15): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (12)..(12): base is a locked nucleic acid
tcmmrcargaatttg

SEQ ID NO: 16216 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (7)..(7): base is a locked nucleic acid
cmmrcargaattt

SEQ ID NO: 16217 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (3)..(3): base is a locked nucleic acid
cmmrcargaattt

SEQ ID NO: 16218 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (2)..(2): base is a locked nucleic acid
cmmrcargaattt

SEQ ID NO: 16219 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (8)..(8): base is a locked nucleic acid
cmmrcargaattt

SEQ ID NO: 16220 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (12)..(12): base is a locked nucleic acid
cmmrcargaattt

SEQ ID NO: 16221 - DNA, 14 bp, Artificial Sequence
  Oligonucleotide probe
  misc_binding (1)..(14): Hybridization probe for the specific detection of wild-type HIV-1 at codon 138 of the integrase gene.
cmmrcargaatttg

SEQ ID NO: 16222 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (10)..(10): base is a locked nucleic acid
cmmrcargaattt

SEQ ID NO: 16223 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (2)..(2): base is a locked nucleic acid
  modified_base (8)..(8): base is a locked nucleic acid
  modified_base (10)..(10): base is a locked nucleic acid
cmmrcargaattt

SEQ ID NO: 16224 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (6)..(6): base is a locked nucleic acid
  modified_base (8)..(8): base is a locked nucleic acid
  modified_base (10)..(10): base is a locked nucleic acid
cmmrcargaattt

SEQ ID NO: 16225 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (3)..(3): base is a locked nucleic acid
  modified_base (8)..(8): base is a locked nucleic acid
  modified_base (10)..(10): base is a locked nucleic acid
cmmrcargaattt

SEQ ID NO: 16226 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (4)..(4): base is a locked nucleic acid
  modified_base (8)..(8): base is a locked nucleic acid
  modified_base (10)..(10): base is a locked nucleic acid
cmmrcargaattt

SEQ ID NO: 16227 - DNA, 14 bp, Artificial Sequence
  Oligonucleotide probe
  misc_binding (1)..(14): Hybridization probe for the specific detection of wild-type HIV-1 at codon 138 of the integrase gene.
  modified_base (8)..(8): base is a locked nucleic acid
  modified_base (10)..(10): base is a locked nucleic acid
cmmrcargaatttg

SEQ ID NO: 16228 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (13)..(13): base is a locked nucleic acid
cmmrcargaattt

SEQ ID NO: 16229 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (8)..(8): base is a locked nucleic acid
  modified_base (10)..(10): base is a locked nucleic acid
cmmrcargaattt

SEQ ID NO: 16230 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (11)..(11): base is a locked nucleic acid
cmmrcargaattt

SEQ ID NO: 16231 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (3)..(3): base is a locked nucleic acid
tcmmrcargaatt

SEQ ID NO: 16232 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (1)..(1): base is a locked nucleic acid
tcmmrcargaatt

SEQ ID NO: 16233 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (4)..(4): base is a locked nucleic acid
tcmmrcargaatt

SEQ ID NO: 16234 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (7)..(7): base is a locked nucleic acid
tcmmrcargaatt

SEQ ID NO: 16235 - DNA, 14 bp, Artificial Sequence
  Oligonucleotide probe
  misc_binding (1)..(14): Hybridization probe for the specific detection of wild-type HIV-1 at codon 138 of the integrase gene.
tcmmrcargaattt

SEQ ID NO: 16236 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (10)..(10): base is a locked nucleic acid
tcmmrcargaatt

SEQ ID NO: 16237 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (13)..(13): base is a locked nucleic acid
tcmmrcargaatt

SEQ ID NO: 16238 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (11)..(11): base is a locked nucleic acid
tcmmrcargaatt

SEQ ID NO: 16239 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (7)..(7): base is a locked nucleic acid
  modified_base (8)..(8): base is a locked nucleic acid
  modified_base (10)..(10): base is a locked nucleic acid
tcmmrcargaatt

SEQ ID NO: 16240 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (5)..(5): base is a locked nucleic acid
  modified_base (8)..(8): base is a locked nucleic acid
  modified_base (10)..(10): base is a locked nucleic acid
tcmmrcargaatt

SEQ ID NO: 16241 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (2)..(2): base is a locked nucleic acid
  modified_base (8)..(8): base is a locked nucleic acid
  modified_base (10)..(10): base is a locked nucleic acid
tcmmrcargaatt

SEQ ID NO: 16242 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (3)..(3): base is a locked nucleic acid
  modified_base (8)..(8): base is a locked nucleic acid
  modified_base (10)..(10): base is a locked nucleic acid
tcmmrcargaatt

SEQ ID NO: 16243 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (13)..(13): base is a locked nucleic acid
tcmmrcargaatt

SEQ ID NO: 16244 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (11)..(11): base is a locked nucleic acid
tcmmrcargaatt

SEQ ID NO: 16245 - DNA, 14 bp, Artificial Sequence
  Oligonucleotide probe
  misc_binding (1)..(14): Hybridization probe for the specific detection of wild-type HIV-1 at codon 138 of the integrase gene.
  modified_base (8)..(8): base is a locked nucleic acid
  modified_base (10)..(10): base is a locked nucleic acid
tcmmrcargaattt

SEQ ID NO: 16246 - DNA, 13 bp, Artificial Sequence
  Oligonucleotide probe
  misc_binding (1)..(13): Hybridization probe for the specific detection of wild-type HIV-1 at codon 138 of the integrase gene.
  modified_base (8)..(8): base is a locked nucleic acid
  modified_base (10)..(10): base is a locked nucleic acid
  modified_base (12)..(12): base is a locked nucleic acid
tcmmrcargaatt

SEQ ID NO: 16247 - DNA, 19 bp, Artificial Sequence
  Oligonucleotide probe
  misc_binding (1)..(19): Hybridization probe for the specific detection of wild-type HIV-1 at codon 138 of the integrase gene.
tcmmrcargaatttggvat

SEQ ID NO: 16248 - DNA, 19 bp, Artificial Sequence
  Oligonucleotide probe
  misc_binding (1)..(19): Hybridization probe for the specific detection of wild-type HIV-1 at codon 138 of the integrase gene.
rtcmmrcargaatttggva

SEQ ID NO: 16249 - DNA, 17 bp, Artificial Sequence
  Oligonucleotide probe
  misc_binding (1)..(17): Hybridization probe for the specific detection of wild-type HIV-1 at codon 138 of the integrase gene.
cmmrcargaatttggva

SEQ ID NO: 16250 - DNA, 17 bp, Artificial Sequence
  Oligonucleotide probe
  misc_binding (1)..(17): Hybridization probe for the specific detection of wild-type HIV-1 at codon 138 of the integrase gene.
tcmmrcargaatttggv

SEQ ID NO: 16251 - DNA, 15 bp, Artificial Sequence
  Oligonucleotide probe
  misc_binding (1)..(15): Hybridization probe for the specific detection of wild-type HIV-1 at codon 138 of the integrase gene.
cmmrcargaatttgg

SEQ ID NO: 16252 - DNA, 15 bp, Artificial Sequence
  Oligonucleotide probe
  misc_binding (1)..(15): Hybridization probe for the specific detection of wild-type HIV-1 at codon 138 of the integrase gene.
tcmmrcargaatttg

SEQ ID NO: 16253 - DNA, 13 bp, Artificial Sequence
  Oligonucleotide probe
  misc_binding (1)..(13): Hybridization probe for the specific detection of wild-type HIV-1 at codon 138 of the integrase gene.
cmmrcargaattt

SEQ ID NO: 16254 - DNA, 13 bp, Artificial Sequence
  Oligonucleotide probe
  misc_binding (1)..(13): Hybridization probe for the specific detection of wild-type HIV-1 at codon 138 of the integrase gene.
tcmmrcargaatt

SEQ ID NO: 16255 - DNA, 15 bp, Artificial Sequence
  Oligonucleotide probe
  misc_binding (1)..(15): Hybridization probe for the specific detection of wild-type HIV-1 at codon 138 of the integrase gene.
aaacaggartttgga

SEQ ID NO: 16256 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (6)..(6): base is a locked nucleic acid
argaatttggvatycccta

SEQ ID NO: 16257 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (4)..(4): base is a locked nucleic acid
argaatttggvatycccta

SEQ ID NO: 16258 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (7)..(7): base is a locked nucleic acid
argaatttggvatycccta

SEQ ID NO: 16259 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
argaatttggvatycccta

SEQ ID NO: 16260 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (17)..(17): base is a locked nucleic acid
argaatttggvatycccta

SEQ ID NO: 16261 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (16)..(16): base is a locked nucleic acid
argaatttggvatycccta

SEQ ID NO: 16262 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (19)..(19): base is a locked nucleic acid
argaatttggvatycccta

SEQ ID NO: 16263 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (13)..(13): base is a locked nucleic acid
argaatttggvatycccta

SEQ ID NO: 16264 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (5)..(5): base is a locked nucleic acid
  modified_base (9)..(9): base is a locked nucleic acid
  modified_base (11)..(11): base is a locked nucleic acid
argaatttggvatycccta

SEQ ID NO: 16265 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (4)..(4): base is a locked nucleic acid
  modified_base (9)..(9): base is a locked nucleic acid
  modified_base (11)..(11): base is a locked nucleic acid
argaatttggvatycccta

SEQ ID NO: 16266 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (8)..(8): base is a locked nucleic acid
  modified_base (9)..(9): base is a locked nucleic acid
  modified_base (11)..(11): base is a locked nucleic acid
argaatttggvatycccta

SEQ ID NO: 16267 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (2)..(2): base is a locked nucleic acid
  modified_base (9)..(9): base is a locked nucleic acid
  modified_base (11)..(11): base is a locked nucleic acid
argaatttggvatycccta

SEQ ID NO: 16268 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (15)..(15): base is a locked nucleic acid
argaatttggvatycccta

SEQ ID NO: 16269 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (19)..(19): base is a locked nucleic acid
argaatttggvatycccta

SEQ ID NO: 16270 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (16)..(16): base is a locked nucleic acid
argaatttggvatycccta

SEQ ID NO: 16271 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (14)..(14): base is a locked nucleic acid
argaatttggvatycccta

SEQ ID NO: 16272 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (5)..(5): base is a locked nucleic acid
cargaatttggvatyccct

SEQ ID NO: 16273 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
cargaatttggvatyccct

SEQ ID NO: 16274 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (3)..(3): base is a locked nucleic acid
cargaatttggvatyccct

SEQ ID NO: 16275 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (8)..(8): base is a locked nucleic acid
cargaatttggvatyccct

SEQ ID NO: 16276 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (15)..(15): base is a locked nucleic acid
cargaatttggvatyccct

SEQ ID NO: 16277 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (16)..(16): base is a locked nucleic acid
cargaatttggvatyccct

SEQ ID NO: 16278 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (17)..(17): base is a locked nucleic acid
cargaatttggvatyccct

SEQ ID NO: 16279 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (13)..(13): base is a locked nucleic acid
cargaatttggvatyccct

SEQ ID NO: 16280 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (4)..(4): base is a locked nucleic acid
  modified_base (9)..(9): base is a locked nucleic acid
  modified_base (11)..(11): base is a locked nucleic acid
cargaatttggvatyccct

SEQ ID NO: 16281 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (3)..(3): base is a locked nucleic acid
  modified_base (9)..(9): base is a locked nucleic acid
  modified_base (11)..(11): base is a locked nucleic acid
cargaatttggvatyccct

SEQ ID NO: 16282 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (2)..(2): base is a locked nucleic acid
  modified_base (9)..(9): base is a locked nucleic acid
  modified_base (11)..(11): base is a locked nucleic acid
cargaatttggvatyccct

SEQ ID NO: 16283 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (8)..(8): base is a locked nucleic acid
  modified_base (9)..(9): base is a locked nucleic acid
  modified_base (11)..(11): base is a locked nucleic acid
cargaatttggvatyccct

SEQ ID NO: 16284 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (13)..(13): base is a locked nucleic acid
cargaatttggvatyccct

SEQ ID NO: 16285 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (16)..(16): base is a locked nucleic acid
cargaatttggvatyccct

SEQ ID NO: 16286 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (14)..(14): base is a locked nucleic acid
cargaatttggvatyccct

SEQ ID NO: 16287 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (18)..(18): base is a locked nucleic acid
cargaatttggvatyccct

SEQ ID NO: 16288 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (7)..(7): base is a locked nucleic acid
cargaatttggvatyccct

SEQ ID NO: 16289 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (4)..(4): base is a locked nucleic acid
cargaatttggvatyccct

SEQ ID NO: 16290 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (2)..(2): base is a locked nucleic acid
cargaatttggvatyccct

SEQ ID NO: 16291 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (19)..(19): base is a locked nucleic acid
cargaatttggvatyccct

SEQ ID NO: 16292 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (11)..(11): base is a locked nucleic acid
cargaatttggvatyccct

SEQ ID NO: 16293 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (5)..(5): base is a locked nucleic acid
  modified_base (9)..(9): base is a locked nucleic acid
  modified_base (11)..(11): base is a locked nucleic acid
cargaatttggvatyccct

SEQ ID NO: 16294 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (6)..(6): base is a locked nucleic acid
  modified_base (9)..(9): base is a locked nucleic acid
  modified_base (11)..(11): base is a locked nucleic acid
cargaatttggvatyccct

SEQ ID NO: 16295 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (12)..(12): base is a locked nucleic acid
cargaatttggvatyccct

SEQ ID NO: 16296 - DNA, 19 bp, Artificial Sequence
  Oligonucleotide probe
  misc_binding (1)..(19): Hybridization probe for the specific detection of wild-type HIV-1 at codon 140 of the integrase gene.
  modified_base (9)..(9): base is a locked nucleic acid
  modified_base (11)..(11): base is a locked nucleic acid
  modified_base (15)..(15): base is a locked nucleic acid
cargaatttggvatyccct

SEQ ID NO: 16297 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (5)..(5): base is a locked nucleic acid
rgaatttggvatyccct

SEQ ID NO: 16298 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (3)..(3): base is a locked nucleic acid
rgaatttggvatyccct

SEQ ID NO: 16299 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (6)..(6): base is a locked nucleic acid
rgaatttggvatyccct

SEQ ID NO: 16300 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
rgaatttggvatyccct

SEQ ID NO: 16301 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (16)..(16): base is a locked nucleic acid
rgaatttggvatyccct

SEQ ID NO: 16302 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (15)..(15): base is a locked nucleic acid
rgaatttggvatyccct

SEQ ID NO: 16303 - DNA, 17 bp, Artificial Sequence
  Oligonucleotide probe
  misc_binding (1)..(17): Hybridization probe for the specific detection of wild-type HIV-1 at codon 140 of the integrase gene.
rgaatttggvatyccct

SEQ ID NO: 16304 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (12)..(12): base is a locked nucleic acid
rgaatttggvatyccct

SEQ ID NO: 16305 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (4)..(4): base is a locked nucleic acid
  modified_base (8)..(8): base is a locked nucleic acid
  modified_base (10)..(10): base is a locked nucleic acid
rgaatttggvatyccct

SEQ ID NO: 16306 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (3)..(3): base is a locked nucleic acid
  modified_base (8)..(8): base is a locked nucleic acid
  modified_base (10)..(10): base is a locked nucleic acid
rgaatttggvatyccct

SEQ ID NO: 16307 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (7)..(7): base is a locked nucleic acid
  modified_base (8)..(8): base is a locked nucleic acid
  modified_base (10)..(10): base is a locked nucleic acid
rgaatttggvatyccct

SEQ ID NO: 16308 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (1)..(1): base is a locked nucleic acid
  modified_base (8)..(8): base is a locked nucleic acid
  modified_base (10)..(10): base is a locked nucleic acid
rgaatttggvatyccct

SEQ ID NO: 16309 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (14)..(14): base is a locked nucleic acid
rgaatttggvatyccct

SEQ ID NO: 16310 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
rgaatttggvatyccct

SEQ ID NO: 16311 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (15)..(15): base is a locked nucleic acid
rgaatttggvatyccct

SEQ ID NO: 16312 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (13)..(13): base is a locked nucleic acid
rgaatttggvatyccct

SEQ ID NO: 16313 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (4)..(4): base is a locked nucleic acid
argaatttggvatyccc

SEQ ID NO: 16314 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
argaatttggvatyccc

SEQ ID NO: 16315 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (2)..(2): base is a locked nucleic acid
argaatttggvatyccc

SEQ ID NO: 16316 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (7)..(7): base is a locked nucleic acid
argaatttggvatyccc

SEQ ID NO: 16317 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (14)..(14): base is a locked nucleic acid
argaatttggvatyccc

SEQ ID NO: 16318 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (15)..(15): base is a locked nucleic acid
argaatttggvatyccc

SEQ ID NO: 16319 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (16)..(16): base is a locked nucleic acid
argaatttggvatyccc

SEQ ID NO: 16320 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (12)..(12): base is a locked nucleic acid
argaatttggvatyccc

SEQ ID NO: 16321 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (3)..(3): base is a locked nucleic acid
  modified_base (8)..(8): base is a locked nucleic acid
  modified_base (10)..(10): base is a locked nucleic acid
argaatttggvatyccc

SEQ ID NO: 16322 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (2)..(2): base is a locked nucleic acid
  modified_base (8)..(8): base is a locked nucleic acid
  modified_base (10)..(10): base is a locked nucleic acid
argaatttggvatyccc

SEQ ID NO: 16323 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (1)..(1): base is a locked nucleic acid
  modified_base (8)..(8): base is a locked nucleic acid
  modified_base (10)..(10): base is a locked nucleic acid
argaatttggvatyccc

SEQ ID NO: 16324 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (7)..(7): base is a locked nucleic acid
  modified_base (8)..(8): base is a locked nucleic acid
  modified_base (10)..(10): base is a locked nucleic acid
argaatttggvatyccc

SEQ ID NO: 16325 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (12)..(12): base is a locked nucleic acid
argaatttggvatyccc

SEQ ID NO: 16326 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (15)..(15): base is a locked nucleic acid
argaatttggvatyccc

SEQ ID NO: 16327 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (13)..(13): base is a locked nucleic acid
argaatttggvatyccc

SEQ ID NO: 16328 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (17)..(17): base is a locked nucleic acid
argaatttggvatyccc

SEQ ID NO: 16329 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (6)..(6): base is a locked nucleic acid
argaatttggvatyccc

SEQ ID NO: 16330 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (3)..(3): base is a locked nucleic acid
argaatttggvatyccc

SEQ ID NO: 16331 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (1)..(1): base is a locked nucleic acid
argaatttggvatyccc

SEQ ID NO: 16332 - DNA, 17 bp, Artificial Sequence
  Oligonucleotide probe
  misc_binding (1)..(17): Hybridization probe for the specific detection of wild-type HIV-1 at codon 140 of the integrase gene.
argaatttggvatyccc

SEQ ID NO: 16333 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (10)..(10): base is a locked nucleic acid
argaatttggvatyccc

SEQ ID NO: 16334 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (4)..(4): base is a locked nucleic acid
  modified_base (8)..(8): base is a locked nucleic acid
  modified_base (10)..(10): base is a locked nucleic acid
argaatttggvatyccc

SEQ ID NO: 16335 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (5)..(5): base is a locked nucleic acid
  modified_base (8)..(8): base is a locked nucleic acid
  modified_base (10)..(10): base is a locked nucleic acid
argaatttggvatyccc

SEQ ID NO: 16336 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (11)..(11): base is a locked nucleic acid
argaatttggvatyccc

SEQ ID NO: 16337 - DNA, 17 bp, Artificial Sequence
  Oligonucleotide probe
  misc_binding (1)..(17): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (14)..(14): base is a locked nucleic acid
argaatttggvatyccc

SEQ ID NO: 16338 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (5)..(5): base is a locked nucleic acid
rgaatttggvatycc

SEQ ID NO: 16339 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (3)..(3): base is a locked nucleic acid
rgaatttggvatycc

SEQ ID NO: 16340 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (6)..(6): base is a locked nucleic acid
rgaatttggvatycc

SEQ ID NO: 16341 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
rgaatttggvatycc

SEQ ID NO: 16342 - DNA, 15 bp, Artificial Sequence
  Oligonucleotide probe
  misc_binding (1)..(15): Hybridization probe for the specific detection of wild-type HIV-1 at codon 140 of the integrase gene.
rgaatttggvatycc

SEQ ID NO: 16343 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (15)..(15): base is a locked nucleic acid
rgaatttggvatycc

SEQ ID NO: 16344 - DNA, 16 bp, Artificial Sequence
  Oligonucleotide probe
  misc_binding (1)..(16): Hybridization probe for the specific detection of wild-type HIV-1 at codon 140 of the integrase gene.
rgaatttggvatyccc

SEQ ID NO: 16345 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (12)..(12): base is a locked nucleic acid
rgaatttggvatycc

SEQ ID NO: 16346 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (4)..(4): base is a locked nucleic acid
  modified_base (8)..(8): base is a locked nucleic acid
  modified_base (10)..(10): base is a locked nucleic acid
rgaatttggvatycc

SEQ ID NO: 16347 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (3)..(3): base is a locked nucleic acid
  modified_base (8)..(8): base is a locked nucleic acid
  modified_base (10)..(10): base is a locked nucleic acid
rgaatttggvatycc

SEQ ID NO: 16348 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (7)..(7): base is a locked nucleic acid
  modified_base (8)..(8): base is a locked nucleic acid
  modified_base (10)..(10): base is a locked nucleic acid
rgaatttggvatycc

SEQ ID NO: 16349 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (1)..(1): base is a locked nucleic acid
  modified_base (8)..(8): base is a locked nucleic acid
  modified_base (10)..(10): base is a locked nucleic acid
rgaatttggvatycc

SEQ ID NO: 16350 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (14)..(14): base is a locked nucleic acid
rgaatttggvatycc

SEQ ID NO: 16351 - DNA, 16 bp, Artificial Sequence
  Oligonucleotide probe
  misc_binding (1)..(16): Hybridization probe for the specific detection of wild-type HIV-1 at codon 140 of the integrase gene.
  modified_base (8)..(8): base is a locked nucleic acid
  modified_base (10)..(10): base is a locked nucleic acid
rgaatttggvatyccc

SEQ ID NO: 16352 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (15)..(15): base is a locked nucleic acid
rgaatttggvatycc

SEQ ID NO: 16353 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (13)..(13): base is a locked nucleic acid
rgaatttggvatycc

SEQ ID NO: 16354 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (4)..(4): base is a locked nucleic acid
argaatttggvatyc

SEQ ID NO: 16355 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
argaatttggvatyc

SEQ ID NO: 16356 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (2)..(2): base is a locked nucleic acid
argaatttggvatyc

SEQ ID NO: 16357 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (7)..(7): base is a locked nucleic acid
argaatttggvatyc

SEQ ID NO: 16358 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (14)..(14): base is a locked nucleic acid
argaatttggvatyc

SEQ ID NO: 16359 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (15)..(15): base is a locked nucleic acid
argaatttggvatyc

SEQ ID NO: 16360 - DNA, 15 bp, Artificial Sequence
  Oligonucleotide probe
  misc_binding (1)..(15): Hybridization probe for the specific detection of wild-type HIV-1 at codon 140 of the integrase gene.
argaatttggvatyc

SEQ ID NO: 16361 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (12)..(12): base is a locked nucleic acid
argaatttggvatyc

SEQ ID NO: 16362 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (3)..(3): base is a locked nucleic acid
  modified_base (8)..(8): base is a locked nucleic acid
  modified_base (10)..(10): base is a locked nucleic acid
argaatttggvatyc

SEQ ID NO: 16363 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (2)..(2): base is a locked nucleic acid
  modified_base (8)..(8): base is a locked nucleic acid
  modified_base (10)..(10): base is a locked nucleic acid
argaatttggvatyc

SEQ ID NO: 16364 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (1)..(1): base is a locked nucleic acid
  modified_base (8)..(8): base is a locked nucleic acid
  modified_base (10)..(10): base is a locked nucleic acid
argaatttggvatyc

SEQ ID NO: 16365 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (7)..(7): base is a locked nucleic acid
  modified_base (8)..(8): base is a locked nucleic acid
  modified_base (10)..(10): base is a locked nucleic acid
argaatttggvatyc

SEQ ID NO: 16366 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (12)..(12): base is a locked nucleic acid
argaatttggvatyc

SEQ ID NO: 16367 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (15)..(15): base is a locked nucleic acid
argaatttggvatyc

SEQ ID NO: 16368 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (13)..(13): base is a locked nucleic acid
argaatttggvatyc

SEQ ID NO: 16369 - DNA, 16 bp, Artificial Sequence
  Oligonucleotide probe
  misc_binding (1)..(16): Hybridization probe for the specific detection of wild-type HIV-1 at codon 140 of the integrase gene.
  modified_base (8)..(8): base is a locked nucleic acid
  modified_base (10)..(10): base is a locked nucleic acid
argaatttggvatycc

SEQ ID NO: 16370 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (6)..(6): base is a locked nucleic acid
argaatttggvatyc

SEQ ID NO: 16371 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (3)..(3): base is a locked nucleic acid
argaatttggvatyc

SEQ ID NO: 16372 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (1)..(1): base is a locked nucleic acid
argaatttggvatyc

SEQ ID NO: 16373 - DNA, 16 bp, Artificial Sequence
  Oligonucleotide probe
  misc_binding (1)..(16): Hybridization probe for the specific detection of wild-type HIV-1 at codon 140 of the integrase gene.
argaatttggvatycc

SEQ ID NO: 16374 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (10)..(10): base is a locked nucleic acid
argaatttggvatyc

SEQ ID NO: 16375 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (4)..(4): base is a locked nucleic acid
  modified_base (8)..(8): base is a locked nucleic acid
  modified_base (10)..(10): base is a locked nucleic acid
argaatttggvatyc

SEQ ID NO: 16376 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (5)..(5): base is a locked nucleic acid
  modified_base (8)..(8): base is a locked nucleic acid
  modified_base (10)..(10): base is a locked nucleic acid
argaatttggvatyc

SEQ ID NO: 16377 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (11)..(11): base is a locked nucleic acid
argaatttggvatyc

SEQ ID NO: 16378 - DNA, 15 bp, Artificial Sequence
  Oligonucleotide probe
  misc_binding (1)..(15): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (14)..(14): base is a locked nucleic acid
argaatttggvatyc

SEQ ID NO: 16379 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (5)..(5): base is a locked nucleic acid
rgaatttggvaty

SEQ ID NO: 16380 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (3)..(3): base is a locked nucleic acid
rgaatttggvaty

SEQ ID NO: 16381 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (6)..(6): base is a locked nucleic acid
rgaatttggvaty

SEQ ID NO: 16382 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
rgaatttggvaty

SEQ ID NO: 16383 - DNA, 14 bp, Artificial Sequence
  Oligonucleotide probe
  misc_binding (1)..(14): Hybridization probe for the specific detection of wild-type HIV-1 at codon 140 of the integrase gene.
rgaatttggvatyc

SEQ ID NO: 16384 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (12)..(12): base is a locked nucleic acid
rgaatttggvaty

SEQ ID NO: 16385 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (4)..(4): base is a locked nucleic acid
  modified_base (8)..(8): base is a locked nucleic acid
  modified_base (10)..(10): base is a locked nucleic acid
rgaatttggvaty

SEQ ID NO: 16386 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (3)..(3): base is a locked nucleic acid
  modified_base (8)..(8): base is a locked nucleic acid
  modified_base (10)..(10): base is a locked nucleic acid
rgaatttggvaty

SEQ ID NO: 16387 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (7)..(7): base is a locked nucleic acid
  modified_base (8)..(8): base is a locked nucleic acid
  modified_base (10)..(10): base is a locked nucleic acid
rgaatttggvaty

SEQ ID NO: 16388 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (1)..(1): base is a locked nucleic acid
  modified_base (8)..(8): base is a locked nucleic acid
  modified_base (10)..(10): base is a locked nucleic acid
rgaatttggvaty

SEQ ID NO: 16389 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
  modified_base (10)..(10): base is a locked nucleic acid
rgaatttggvaty

SEQ ID NO: 16390 - DNA, 14 bp, Artificial Sequence
  Oligonucleotide probe
  misc_binding (1)..(14): Hybridization probe for the specific detection of wild-type HIV-1 at codon 140 of the integrase gene.
  modified_base (8)..(8): base is a locked nucleic acid
  modified_base (10)..(10): base is a locked nucleic acid
rgaatttggvatyc

SEQ ID NO: 16391 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (13)..(13): base is a locked nucleic acid
rgaatttggvaty

SEQ ID NO: 16392 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (4)..(4): base is a locked nucleic acid
argaatttggvat

SEQ ID NO: 16393 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
argaatttggvat

SEQ ID NO: 16394 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (2)..(2): base is a locked nucleic acid
argaatttggvat

SEQ ID NO: 16395 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (7)..(7): base is a locked nucleic acid
argaatttggvat

SEQ ID NO: 16396 - DNA, 13 bp, Artificial Sequence
  Oligonucleotide probe
  misc_binding (1)..(13): Hybridization probe for the specific detection of wild-type HIV-1 at codon 140 of the integrase gene.
argaatttggvat

SEQ ID NO: 16397 - DNA, 14 bp, Artificial Sequence
  Oligonucleotide probe
  misc_binding (1)..(14): Hybridization probe for the specific detection of wild-type HIV-1 at codon 140 of the integrase gene.
argaatttggvaty

SEQ ID NO: 16398 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (12)..(12): base is a locked nucleic acid
argaatttggvat

SEQ ID NO: 16399 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (3)..(3): base is a locked nucleic acid
  modified_base (8)..(8): base is a locked nucleic acid
  modified_base (10)..(10): base is a locked nucleic acid
argaatttggvat

SEQ ID NO: 16400 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (2)..(2): base is a locked nucleic acid
  modified_base (8)..(8): base is a locked nucleic acid
  modified_base (10)..(10): base is a locked nucleic acid
argaatttggvat

SEQ ID NO: 16401 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (1)..(1): base is a locked nucleic acid
  modified_base (8)..(8): base is a locked nucleic acid
  modified_base (10)..(10): base is a locked nucleic acid
argaatttggvat

SEQ ID NO: 16402 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (7)..(7): base is a locked nucleic acid
  modified_base (8)..(8): base is a locked nucleic acid
  modified_base (10)..(10): base is a locked nucleic acid
argaatttggvat

SEQ ID NO: 16403 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (12)..(12): base is a locked nucleic acid
argaatttggvat

SEQ ID NO: 16404 - DNA, 14 bp, Artificial Sequence
  Oligonucleotide probe
  misc_binding (1)..(14): Hybridization probe for the specific detection of wild-type HIV-1 at codon 140 of the integrase gene.
  modified_base (8)..(8): base is a locked nucleic acid
  modified_base (10)..(10): base is a locked nucleic acid
argaatttggvaty

SEQ ID NO: 16405 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (13)..(13): base is a locked nucleic acid
argaatttggvat

SEQ ID NO: 16406 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (6)..(6): base is a locked nucleic acid
argaatttggvat

SEQ ID NO: 16407 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (3)..(3): base is a locked nucleic acid
argaatttggvat

SEQ ID NO: 16408 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (1)..(1): base is a locked nucleic acid
argaatttggvat

SEQ ID NO: 16409 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (10)..(10): base is a locked nucleic acid
argaatttggvat

SEQ ID NO: 16410 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (4)..(4): base is a locked nucleic acid
  modified_base (8)..(8): base is a locked nucleic acid
  modified_base (10)..(10): base is a locked nucleic acid
argaatttggvat

SEQ ID NO: 16411 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (5)..(5): base is a locked nucleic acid
  modified_base (8)..(8): base is a locked nucleic acid
  modified_base (10)..(10): base is a locked nucleic acid
argaatttggvat

SEQ ID NO: 16412 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
  modified_base (10)..(10): base is a locked nucleic acid
  modified_base (11)..(11): base is a locked nucleic acid
argaatttggvat

SEQ ID NO: 16413 - DNA, 13 bp, Artificial Sequence
  Oligonucleotide probe
  misc_binding (1)..(13): Hybridization probe for the specific detection of wild-type HIV-1 at codon 140 of the integrase gene.
  modified_base (8)..(8): base is a locked nucleic acid
  modified_base (10)..(10): base is a locked nucleic acid
argaatttggvat

SEQ ID NO: 16414 - DNA, 19 bp, Artificial Sequence
  Oligonucleotide probe
  misc_binding (1)..(19): Hybridization probe for the specific detection of wild-type HIV-1 at codon 140 of the integrase gene.
argaatttggvatycccta

SEQ ID NO: 16415 - DNA, 19 bp, Artificial Sequence
  Oligonucleotide probe
  misc_binding (1)..(19): Hybridization probe for the specific detection of wild-type HIV-1 at codon 140 of the integrase gene.
cargaatttggvatyccct

SEQ ID NO: 16416 - DNA, 17 bp, Artificial Sequence
  Oligonucleotide probe
  misc_binding (1)..(17): Hybridization probe for the specific detection of wild-type HIV-1 at codon 140 of the integrase gene.
rgaatttggvatyccct

SEQ ID NO: 16417 - DNA, 17 bp, Artificial Sequence
  Oligonucleotide probe
  misc_binding (1)..(17): Hybridization probe for the specific detection of wild-type HIV-1 at codon 140 of the integrase gene.
argaatttggvatyccc

SEQ ID NO: 16418 - DNA, 15 bp, Artificial Sequence
  Oligonucleotide probe
  misc_binding (1)..(15): Hybridization probe for the specific detection of wild-type HIV-1 at codon 140 of the integrase gene.
rgaatttggvatycc

SEQ ID NO: 16419 - DNA, 15 bp, Artificial Sequence
  Oligonucleotide probe
  misc_binding (1)..(15): Hybridization probe for the specific detection of wild-type HIV-1 at codon 140 of the integrase gene.
argaatttggvatyc

SEQ ID NO: 16420 - DNA, 13 bp, Artificial Sequence
  Oligonucleotide probe
  misc_binding (1)..(13): Hybridization probe for the specific detection of wild-type HIV-1 at codon 140 of the integrase gene.
rgaatttggvaty

SEQ ID NO: 16421 - DNA, 13 bp, Artificial Sequence
  Oligonucleotide probe
  misc_binding (1)..(13): Hybridization probe for the specific detection of wild-type HIV-1 at codon 140 of the integrase gene.
argaatttggvat

SEQ ID NO: 16422 - DNA, 15 bp, Artificial Sequence
  Oligonucleotide probe
  misc_binding (1)..(15): Hybridization probe for the specific detection of wild-type HIV-1 at codon 140 of the integrase gene.
  misc_feature (8)..(8): n is a, c, g, or t
aatttggnattccct

SEQ ID NO: 16423 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (5)..(5): base is a locked nucleic acid
gvatyccctacaatcccca

SEQ ID NO: 16424 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (3)..(3): base is a locked nucleic acid
gvatyccctacaatcccca

SEQ ID NO: 16425 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (6)..(6): base is a locked nucleic acid
gvatyccctacaatcccca

SEQ ID NO: 16426 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
gvatyccctacaatcccca

SEQ ID NO: 16427 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (16)..(16): base is a locked nucleic acid
gvatyccctacaatcccca

SEQ ID NO: 16428 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (17)..(17): base is a locked nucleic acid
gvatyccctacaatcccca

SEQ ID NO: 16429 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (12)..(12): base is a locked nucleic acid
gvatyccctacaatcccca

SEQ ID NO: 16430 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (15)..(15): base is a locked nucleic acid
gvatyccctacaatcccca

SEQ ID NO: 16431 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (3)..(3): base is a locked nucleic acid
  modified_base (9)..(9): base is a locked nucleic acid
  modified_base (11)..(11): base is a locked nucleic acid
gvatyccctacaatcccca

SEQ ID NO: 16432 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (7)..(7): base is a locked nucleic acid
  modified_base (9)..(9): base is a locked nucleic acid
  modified_base (11)..(11): base is a locked nucleic acid
gvatyccctacaatcccca

SEQ ID NO: 16433 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (2)..(2): base is a locked nucleic acid
  modified_base (9)..(9): base is a locked nucleic acid
  modified_base (11)..(11): base is a locked nucleic acid
gvatyccctacaatcccca

SEQ ID NO: 16434 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (6)..(6): base is a locked nucleic acid
  modified_base (9)..(9): base is a locked nucleic acid
  modified_base (11)..(11): base is a locked nucleic acid
gvatyccctacaatcccca

SEQ ID NO: 16435 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (18)..(18): base is a locked nucleic acid
gvatyccctacaatcccca

SEQ ID NO: 16436 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (14)..(14): base is a locked nucleic acid
gvatyccctacaatcccca

SEQ ID NO: 16437 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (19)..(19): base is a locked nucleic acid
gvatyccctacaatcccca

SEQ ID NO: 16438 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (12)..(12): base is a locked nucleic acid
gvatyccctacaatcccca

SEQ ID NO: 16439 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (2)..(2): base is a locked nucleic acid
ggvatyccctacaatcccc

SEQ ID NO: 16440 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (3)..(3): base is a locked nucleic acid
ggvatyccctacaatcccc

SEQ ID NO: 16441 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
ggvatyccctacaatcccc

SEQ ID NO: 16442 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (5)..(5): base is a locked nucleic acid
ggvatyccctacaatcccc

SEQ ID NO: 16443 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (15)..(15): base is a locked nucleic acid
ggvatyccctacaatcccc

SEQ ID NO: 16444 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (19)..(19): base is a locked nucleic acid
ggvatyccctacaatcccc

SEQ ID NO: 16445 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (12)..(12): base is a locked nucleic acid
ggvatyccctacaatcccc

SEQ ID NO: 16446 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (13)..(13): base is a locked nucleic acid
ggvatyccctacaatcccc

SEQ ID NO: 16447 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (7)..(7): base is a locked nucleic acid
  modified_base (9)..(9): base is a locked nucleic acid
  modified_base (11)..(11): base is a locked nucleic acid
ggvatyccctacaatcccc

SEQ ID NO: 16448 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (6)..(6): base is a locked nucleic acid
  modified_base (9)..(9): base is a locked nucleic acid
  modified_base (11)..(11): base is a locked nucleic acid
ggvatyccctacaatcccc

SEQ ID NO: 16449 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (3)..(3): base is a locked nucleic acid
  modified_base (9)..(9): base is a locked nucleic acid
  modified_base (11)..(11): base is a locked nucleic acid
ggvatyccctacaatcccc

SEQ ID NO: 16450 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (5)..(5): base is a locked nucleic acid
  modified_base (9)..(9): base is a locked nucleic acid
  modified_base (11)..(11): base is a locked nucleic acid
ggvatyccctacaatcccc

SEQ ID NO: 16451 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (17)..(17): base is a locked nucleic acid
ggvatyccctacaatcccc

SEQ ID NO: 16452 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (12)..(12): base is a locked nucleic acid
ggvatyccctacaatcccc

SEQ ID NO: 16453 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (15)..(15): base is a locked nucleic acid
ggvatyccctacaatcccc

SEQ ID NO: 16454 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (19)..(19): base is a locked nucleic acid
ggvatyccctacaatcccc

SEQ ID NO: 16455 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (2)..(2): base is a locked nucleic acid
gvatyccctacaatcccca

SEQ ID NO: 16456 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (4)..(4): base is a locked nucleic acid
gvatyccctacaatcccca

SEQ ID NO: 16457 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (19)..(19): base is a locked nucleic acid
gvatyccctacaatcccca

SEQ ID NO: 16458 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (13)..(13): base is a locked nucleic acid
gvatyccctacaatcccca

SEQ ID NO: 16459 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (8)..(8): base is a locked nucleic acid
  modified_base (9)..(9): base is a locked nucleic acid
  modified_base (11)..(11): base is a locked nucleic acid
gvatyccctacaatcccca

SEQ ID NO: 16460 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (15)..(15): base is a locked nucleic acid
gvatyccctacaatcccca

SEQ ID NO: 16461 - DNA, 19 bp, Artificial Sequence
  Oligonucleotide probe
  misc_binding (1)..(19): Hybridization probe for the specific detection of wild-type HIV-1 at codon 143 of the integrase gene.
  modified_base (9)..(9): base is a locked nucleic acid
  modified_base (11)..(11): base is a locked nucleic acid
  modified_base (13)..(13): base is a locked nucleic acid
gvatyccctacaatcccca

SEQ ID NO: 16462 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (4)..(4): base is a locked nucleic acid
vatyccctacaatcccc

SEQ ID NO: 16463 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (2)..(2): base is a locked nucleic acid
vatyccctacaatcccc

SEQ ID NO: 16464 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (5)..(5): base is a locked nucleic acid
vatyccctacaatcccc

SEQ ID NO: 16465 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
vatyccctacaatcccc

SEQ ID NO: 16466 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (15)..(15): base is a locked nucleic acid
vatyccctacaatcccc

SEQ ID NO: 16467 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (16)..(16): base is a locked nucleic acid
vatyccctacaatcccc

SEQ ID NO: 16468 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (11)..(11): base is a locked nucleic acid
vatyccctacaatcccc

SEQ ID NO: 16469 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (14)..(14): base is a locked nucleic acid
vatyccctacaatcccc

SEQ ID NO: 16470 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (2)..(2): base is a locked nucleic acid
  modified_base (8)..(8): base is a locked nucleic acid
  modified_base (10)..(10): base is a locked nucleic acid
vatyccctacaatcccc

SEQ ID NO: 16471 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (6)..(6): base is a locked nucleic acid
  modified_base (8)..(8): base is a locked nucleic acid
  modified_base (10)..(10): base is a locked nucleic acid
vatyccctacaatcccc

SEQ ID NO: 16472 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (1)..(1): base is a locked nucleic acid
  modified_base (8)..(8): base is a locked nucleic acid
  modified_base (10)..(10): base is a locked nucleic acid
vatyccctacaatcccc

SEQ ID NO: 16473 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (5)..(5): base is a locked nucleic acid
  modified_base (8)..(8): base is a locked nucleic acid
  modified_base (10)..(10): base is a locked nucleic acid
vatyccctacaatcccc

SEQ ID NO: 16474 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (17)..(17): base is a locked nucleic acid
vatyccctacaatcccc

SEQ ID NO: 16475 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (13)..(13): base is a locked nucleic acid
vatyccctacaatcccc

SEQ ID NO: 16476 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
vatyccctacaatcccc

SEQ ID NO: 16477 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (11)..(11): base is a locked nucleic acid
vatyccctacaatcccc

SEQ ID NO: 16478 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (1)..(1): base is a locked nucleic acid
gvatyccctacaatccc

SEQ ID NO: 16479 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (2)..(2): base is a locked nucleic acid
gvatyccctacaatccc

SEQ ID NO: 16480 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
gvatyccctacaatccc

SEQ ID NO: 16481 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (4)..(4): base is a locked nucleic acid
gvatyccctacaatccc

SEQ ID NO: 16482 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (14)..(14): base is a locked nucleic acid
gvatyccctacaatccc

SEQ ID NO: 16483 - DNA, 17 bp, Artificial Sequence
  Oligonucleotide probe
  misc_binding (1)..(17): Hybridization probe for the specific detection of wild-type HIV-1 at codon 143 of the integrase gene.
gvatyccctacaatccc

SEQ ID NO: 16484 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (11)..(11): base is a locked nucleic acid
gvatyccctacaatccc

SEQ ID NO: 16485 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (12)..(12): base is a locked nucleic acid
gvatyccctacaatccc

SEQ ID NO: 16486 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (6)..(6): base is a locked nucleic acid
  modified_base (8)..(8): base is a locked nucleic acid
  modified_base (10)..(10): base is a locked nucleic acid
gvatyccctacaatccc

SEQ ID NO: 16487 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (5)..(5): base is a locked nucleic acid
  modified_base (8)..(8): base is a locked nucleic acid
  modified_base (10)..(10): base is a locked nucleic acid
gvatyccctacaatccc

SEQ ID NO: 16488 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (2)..(2): base is a locked nucleic acid
  modified_base (8)..(8): base is a locked nucleic acid
  modified_base (10)..(10): base is a locked nucleic acid
gvatyccctacaatccc

SEQ ID NO: 16489 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (4)..(4): base is a locked nucleic acid
  modified_base (8)..(8): base is a locked nucleic acid
  modified_base (10)..(10): base is a locked nucleic acid
gvatyccctacaatccc

SEQ ID NO: 16490 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (16)..(16): base is a locked nucleic acid
gvatyccctacaatccc

SEQ ID NO: 16491 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (11)..(11): base is a locked nucleic acid
gvatyccctacaatccc

SEQ ID NO: 16492 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (14)..(14): base is a locked nucleic acid
gvatyccctacaatccc

SEQ ID NO: 16493 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
gvatyccctacaatccc

SEQ ID NO: 16494 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (1)..(1): base is a locked nucleic acid
vatyccctacaatcccc

SEQ ID NO: 16495 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (3)..(3): base is a locked nucleic acid
vatyccctacaatcccc

SEQ ID NO: 16496 - DNA, 17 bp, Artificial Sequence
  Oligonucleotide probe
  misc_binding (1)..(17): Hybridization probe for the specific detection of wild-type HIV-1 at codon 143 of the integrase gene.
vatyccctacaatcccc

SEQ ID NO: 16497 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (12)..(12): base is a locked nucleic acid
vatyccctacaatcccc

SEQ ID NO: 16498 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (7)..(7): base is a locked nucleic acid
  modified_base (8)..(8): base is a locked nucleic acid
  modified_base (10)..(10): base is a locked nucleic acid
vatyccctacaatcccc

SEQ ID NO: 16499 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (14)..(14): base is a locked nucleic acid
vatyccctacaatcccc

SEQ ID NO: 16500 - DNA, 17 bp, Artificial Sequence
  Oligonucleotide probe
  misc_binding (1)..(17): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (12)..(12): base is a locked nucleic acid
vatyccctacaatcccc

SEQ ID NO: 16501 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (4)..(4): base is a locked nucleic acid
vatyccctacaatcc

SEQ ID NO: 16502 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (2)..(2): base is a locked nucleic acid
vatyccctacaatcc

SEQ ID NO: 16503 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (5)..(5): base is a locked nucleic acid
vatyccctacaatcc

SEQ ID NO: 16504 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
vatyccctacaatcc

SEQ ID NO: 16505 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (15)..(15): base is a locked nucleic acid
vatyccctacaatcc

SEQ ID NO: 16506 - DNA, 15 bp, Artificial Sequence
  Oligonucleotide probe
  misc_binding (1)..(15): Hybridization probe for the specific detection of wild-type HIV-1 at codon 143 of the integrase gene.
vatyccctacaatcc

SEQ ID NO: 16507 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (11)..(11): base is a locked nucleic acid
vatyccctacaatcc

SEQ ID NO: 16508 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (14)..(14): base is a locked nucleic acid
vatyccctacaatcc

SEQ ID NO: 16509 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (2)..(2): base is a locked nucleic acid
  modified_base (8)..(8): base is a locked nucleic acid
  modified_base (10)..(10): base is a locked nucleic acid
vatyccctacaatcc

SEQ ID NO: 16510 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (6)..(6): base is a locked nucleic acid
  modified_base (8)..(8): base is a locked nucleic acid
  modified_base (10)..(10): base is a locked nucleic acid
vatyccctacaatcc

SEQ ID NO: 16511 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (1)..(1): base is a locked nucleic acid
  modified_base (8)..(8): base is a locked nucleic acid
  modified_base (10)..(10): base is a locked nucleic acid
vatyccctacaatcc

SEQ ID NO: 16512 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (5)..(5): base is a locked nucleic acid
  modified_base (8)..(8): base is a locked nucleic acid
  modified_base (10)..(10): base is a locked nucleic acid
vatyccctacaatcc

SEQ ID NO: 16513 - DNA, 16 bp, Artificial Sequence
  Oligonucleotide probe
  misc_binding (1)..(16): Hybridization probe for the specific detection of wild-type HIV-1 at codon 143 of the integrase gene.
  modified_base (8)..(8): base is a locked nucleic acid
  modified_base (10)..(10): base is a locked nucleic acid
vatyccctacaatccc

SEQ ID NO: 16514 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (13)..(13): base is a locked nucleic acid
vatyccctacaatcc

SEQ ID NO: 16515 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (11)..(11): base is a locked nucleic acid
vatyccctacaatcc

SEQ ID NO: 16516 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (1)..(1): base is a locked nucleic acid
gvatyccctacaatc

SEQ ID NO: 16517 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (2)..(2): base is a locked nucleic acid
gvatyccctacaatc

SEQ ID NO: 16518 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
gvatyccctacaatc

SEQ ID NO: 16519 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (4)..(4): base is a locked nucleic acid
gvatyccctacaatc

SEQ ID NO: 16520 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (14)..(14): base is a locked nucleic acid
gvatyccctacaatc

SEQ ID NO: 16521 - DNA, 16 bp, Artificial Sequence
  Oligonucleotide probe
  misc_binding (1)..(16): Hybridization probe for the specific detection of wild-type HIV-1 at codon 143 of the integrase gene.
gvatyccctacaatcc

SEQ ID NO: 16522 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (11)..(11): base is a locked nucleic acid
gvatyccctacaatc

SEQ ID NO: 16523 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (12)..(12): base is a locked nucleic acid
gvatyccctacaatc

SEQ ID NO: 16524 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (6)..(6): base is a locked nucleic acid
  modified_base (8)..(8): base is a locked nucleic acid
  modified_base (10)..(10): base is a locked nucleic acid
gvatyccctacaatc

SEQ ID NO: 16525 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (5)..(5): base is a locked nucleic acid
  modified_base (8)..(8): base is a locked nucleic acid
  modified_base (10)..(10): base is a locked nucleic acid
gvatyccctacaatc

SEQ ID NO: 16526 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (2)..(2): base is a locked nucleic acid
  modified_base (8)..(8): base is a locked nucleic acid
  modified_base (10)..(10): base is a locked nucleic acid
gvatyccctacaatc

SEQ ID NO: 16527 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (4)..(4): base is a locked nucleic acid
  modified_base (8)..(8): base is a locked nucleic acid
  modified_base (10)..(10): base is a locked nucleic acid
gvatyccctacaatc

SEQ ID NO: 16528 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
  modified_base (10)..(10): base is a locked nucleic acid
gvatyccctacaatc

SEQ ID NO: 16529 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (11)..(11): base is a locked nucleic acid
gvatyccctacaatc

SEQ ID NO: 16530 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (14)..(14): base is a locked nucleic acid
gvatyccctacaatc

SEQ ID NO: 16531 - DNA, 16 bp, Artificial Sequence
  Oligonucleotide probe
  misc_binding (1)..(16): Hybridization probe for the specific detection of wild-type HIV-1 at codon 143 of the integrase gene.
  modified_base (8)..(8): base is a locked nucleic acid
  modified_base (10)..(10): base is a locked nucleic acid
gvatyccctacaatcc

SEQ ID NO: 16532 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (1)..(1): base is a locked nucleic acid
vatyccctacaatcc

SEQ ID NO: 16533 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (3)..(3): base is a locked nucleic acid
vatyccctacaatcc

SEQ ID NO: 16534 - DNA, 16 bp, Artificial Sequence
  Oligonucleotide probe
  misc_binding (1)..(16): Hybridization probe for the specific detection of wild-type HIV-1 at codon 143 of the integrase gene.
vatyccctacaatccc

SEQ ID NO: 16535 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (12)..(12): base is a locked nucleic acid
vatyccctacaatcc

SEQ ID NO: 16536 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (7)..(7): base is a locked nucleic acid
  modified_base (8)..(8): base is a locked nucleic acid
  modified_base (10)..(10): base is a locked nucleic acid
vatyccctacaatcc

SEQ ID NO: 16537 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (14)..(14): base is a locked nucleic acid
vatyccctacaatcc

SEQ ID NO: 16538 - DNA, 15 bp, Artificial Sequence
  Oligonucleotide probe
  misc_binding (1)..(15): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (12)..(12): base is a locked nucleic acid
vatyccctacaatcc

SEQ ID NO: 16539 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (4)..(4): base is a locked nucleic acid
vatyccctacaat

SEQ ID NO: 16540 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (2)..(2): base is a locked nucleic acid
vatyccctacaat

SEQ ID NO: 16541 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (5)..(5): base is a locked nucleic acid
vatyccctacaat

SEQ ID NO: 16542 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
vatyccctacaat

SEQ ID NO: 16543 - DNA, 14 bp, Artificial Sequence
  Oligonucleotide probe
  misc_binding (1)..(14): Hybridization probe for the specific detection of wild-type HIV-1 at codon 143 of the integrase gene.
vatyccctacaatc

SEQ ID NO: 16544 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (11)..(11): base is a locked nucleic acid
vatyccctacaat

SEQ ID NO: 16545 - DNA, 13 bp, Artificial Sequence
  Oligonucleotide probe
  misc_binding (1)..(13): Hybridization probe for the specific detection of wild-type HIV-1 at codon 143 of the integrase gene.
vatyccctacaat

SEQ ID NO: 16546 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (2)..(2): base is a locked nucleic acid
  modified_base (8)..(8): base is a locked nucleic acid
  modified_base (10)..(10): base is a locked nucleic acid
vatyccctacaat

SEQ ID NO: 16547 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (6)..(6): base is a locked nucleic acid
  modified_base (8)..(8): base is a locked nucleic acid
  modified_base (10)..(10): base is a locked nucleic acid
vatyccctacaat

SEQ ID NO: 16548 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (1)..(1): base is a locked nucleic acid
  modified_base (8)..(8): base is a locked nucleic acid
  modified_base (10)..(10): base is a locked nucleic acid
vatyccctacaat

SEQ ID NO: 16549 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (5)..(5): base is a locked nucleic acid
  modified_base (8)..(8): base is a locked nucleic acid
  modified_base (10)..(10): base is a locked nucleic acid
vatyccctacaat

SEQ ID NO: 16550 - DNA, 14 bp, Artificial Sequence
  Oligonucleotide probe
  misc_binding (1)..(14): Hybridization probe for the specific detection of wild-type HIV-1 at codon 143 of the integrase gene.
  modified_base (8)..(8): base is a locked nucleic acid
  modified_base (10)..(10): base is a locked nucleic acid
vatyccctacaatc

SEQ ID NO: 16551 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (13)..(13): base is a locked nucleic acid
vatyccctacaat

SEQ ID NO: 16552 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (11)..(11): base is a locked nucleic acid
vatyccctacaat

SEQ ID NO: 16553 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (1)..(1): base is a locked nucleic acid
gvatyccctacaa

SEQ ID NO: 16554 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (2)..(2): base is a locked nucleic acid
gvatyccctacaa

SEQ ID NO: 16555 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
gvatyccctacaa

SEQ ID NO: 16556 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (4)..(4): base is a locked nucleic acid
gvatyccctacaa

SEQ ID NO: 16557 - DNA, 13 bp, Artificial Sequence
  Oligonucleotide probe
  misc_binding (1)..(13): Hybridization probe for the specific detection of wild-type HIV-1 at codon 143 of the integrase gene.
gvatyccctacaa

SEQ ID NO: 16558 - DNA, 14 bp, Artificial Sequence
  Oligonucleotide probe
  misc_binding (1)..(14): Hybridization probe for the specific detection of wild-type HIV-1 at codon 143 of the integrase gene.
gvatyccctacaat

SEQ ID NO: 16559 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (11)..(11): base is a locked nucleic acid
gvatyccctacaa

SEQ ID NO: 16560 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (12)..(12): base is a locked nucleic acid
gvatyccctacaa

SEQ ID NO: 16561 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (6)..(6): base is a locked nucleic acid
  modified_base (8)..(8): base is a locked nucleic acid
  modified_base (10)..(10): base is a locked nucleic acid
gvatyccctacaa

SEQ ID NO: 16562 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (5)..(5): base is a locked nucleic acid
  modified_base (8)..(8): base is a locked nucleic acid
  modified_base (10)..(10): base is a locked nucleic acid
gvatyccctacaa

SEQ ID NO: 16563 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (2)..(2): base is a locked nucleic acid
  modified_base (8)..(8): base is a locked nucleic acid
  modified_base (10)..(10): base is a locked nucleic acid
gvatyccctacaa

SEQ ID NO: 16564 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (4)..(4): base is a locked nucleic acid
  modified_base (8)..(8): base is a locked nucleic acid
  modified_base (10)..(10): base is a locked nucleic acid
gvatyccctacaa

SEQ ID NO: 16565 - DNA, 14 bp, Artificial Sequence
  Oligonucleotide probe
  misc_binding (1)..(14): Hybridization probe for the specific detection of wild-type HIV-1 at codon 143 of the integrase gene.
  modified_base (8)..(8): base is a locked nucleic acid
  modified_base (10)..(10): base is a locked nucleic acid
gvatyccctacaat

SEQ ID NO: 16566 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (11)..(11): base is a locked nucleic acid
gvatyccctacaa

SEQ ID NO: 16567 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
  modified_base (10)..(10): base is a locked nucleic acid
gvatyccctacaa

SEQ ID NO: 16568 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (1)..(1): base is a locked nucleic acid
vatyccctacaat

SEQ ID NO: 16569 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (3)..(3): base is a locked nucleic acid
vatyccctacaat

SEQ ID NO: 16570 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (12)..(12): base is a locked nucleic acid
vatyccctacaat

SEQ ID NO: 16571 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (7)..(7): base is a locked nucleic acid
  modified_base (8)..(8): base is a locked nucleic acid
  modified_base (10)..(10): base is a locked nucleic acid
vatyccctacaat

SEQ ID NO: 16572 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
  modified_base (10)..(10): base is a locked nucleic acid
vatyccctacaat

SEQ ID NO: 16573 - DNA, 13 bp, Artificial Sequence
  Oligonucleotide probe
  misc_binding (1)..(13): Hybridization probe for the specific detection of wild-type HIV-1 at codon 143 of the integrase gene.
  modified_base (8)..(8): base is a locked nucleic acid
  modified_base (10)..(10): base is a locked nucleic acid
  modified_base (12)..(12): base is a locked nucleic acid
vatyccctacaat

SEQ ID NO: 16574 - DNA, 19 bp, Artificial Sequence
  Oligonucleotide probe
  misc_binding (1)..(19): Hybridization probe for the specific detection of wild-type HIV-1 at codon 143 of the integrase gene.
gvatyccctacaatcccca

SEQ ID NO: 16575 - DNA, 19 bp, Artificial Sequence
  Oligonucleotide probe
  misc_binding (1)..(19): Hybridization probe for the specific detection of wild-type HIV-1 at codon 143 of the integrase gene.
ggvatyccctacaatcccc

SEQ ID NO: 16576 - DNA, 17 bp, Artificial Sequence
  Oligonucleotide probe
  misc_binding (1)..(17): Hybridization probe for the specific detection of wild-type HIV-1 at codon 143 of the integrase gene.
vatyccctacaatcccc

SEQ ID NO: 16577 - DNA, 17 bp, Artificial Sequence
  Oligonucleotide probe
  misc_binding (1)..(17): Hybridization probe for the specific detection of wild-type HIV-1 at codon 143 of the integrase gene.
gvatyccctacaatccc

SEQ ID NO: 16578 - DNA, 15 bp, Artificial Sequence
  Oligonucleotide probe
  misc_binding (1)..(15): Hybridization probe for the specific detection of wild-type HIV-1 at codon 143 of the integrase gene.
vatyccctacaatcc

SEQ ID NO: 16579 - DNA, 15 bp, Artificial Sequence
  Oligonucleotide probe
  misc_binding (1)..(15): Hybridization probe for the specific detection of wild-type HIV-1 at codon 143 of the integrase gene.
gvatyccctacaatc

SEQ ID NO: 16580 - DNA, 13 bp, Artificial Sequence
  Oligonucleotide probe
  misc_binding (1)..(13): Hybridization probe for the specific detection of wild-type HIV-1 at codon 143 of the integrase gene.
vatyccctacaat

SEQ ID NO: 16581 - DNA, 13 bp, Artificial Sequence
  Oligonucleotide probe
  misc_binding (1)..(13): Hybridization probe for the specific detection of wild-type HIV-1 at codon 143 of the integrase gene.
gvatyccctacaa

SEQ ID NO: 16582 - DNA, 15 bp, Artificial Sequence
  Oligonucleotide probe
  misc_binding (1)..(15): Hybridization probe for the specific detection of wild-type HIV-1 at codon 143 of the integrase gene.
attccctayaatccc

SEQ ID NO: 16583 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (2)..(2): base is a locked nucleic acid
ccctacaatccccaaagyc

SEQ ID NO: 16584 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (3)..(3): base is a locked nucleic acid
ccctacaatccccaaagyc

SEQ ID NO: 16585 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (9)..(9): base is a locked nucleic acid
ccctacaatccccaaagyc

SEQ ID NO: 16586 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (4)..(4): base is a locked nucleic acid
ccctacaatccccaaagyc

SEQ ID NO: 16587 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (19)..(19): base is a locked nucleic acid
ccctacaatccccaaagyc

SEQ ID NO: 16588 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (15)..(15): base is a locked nucleic acid
ccctacaatccccaaagyc

SEQ ID NO: 16589 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (14)..(14): base is a locked nucleic acid
ccctacaatccccaaagyc

SEQ ID NO: 16590 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (16)..(16): base is a locked nucleic acid
ccctacaatccccaaagyc

SEQ ID NO: 16591 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (3)..(3): base is a locked nucleic acid
  modified_base (9)..(9): base is a locked nucleic acid
  modified_base (11)..(11): base is a locked nucleic acid
ccctacaatccccaaagyc

SEQ ID NO: 16592 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (4)..(4): base is a locked nucleic acid
  modified_base (9)..(9): base is a locked nucleic acid
  modified_base (11)..(11): base is a locked nucleic acid
ccctacaatccccaaagyc

SEQ ID NO: 16593 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (8)..(8): base is a locked nucleic acid
  modified_base (9)..(9): base is a locked nucleic acid
  modified_base (11)..(11): base is a locked nucleic acid
ccctacaatccccaaagyc

SEQ ID NO: 16594 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (6)..(6): base is a locked nucleic acid
  modified_base (9)..(9): base is a locked nucleic acid
  modified_base (11)..(11): base is a locked nucleic acid
ccctacaatccccaaagyc

SEQ ID NO: 16595 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (9)..(9): base is a locked nucleic acid
  modified_base (11)..(11): base is a locked nucleic acid
  modified_base (16)..(16): base is a locked nucleic acid
ccctacaatccccaaagyc

SEQ ID NO: 16596 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (9)..(9): base is a locked nucleic acid
  modified_base (11)..(11): base is a locked nucleic acid
  modified_base (12)..(12): base is a locked nucleic acid
ccctacaatccccaaagyc

SEQ ID NO: 16597 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (9)..(9): base is a locked nucleic acid
  modified_base (11)..(11): base is a locked nucleic acid
  modified_base (15)..(15): base is a locked nucleic acid
ccctacaatccccaaagyc

SEQ ID NO: 16598 - DNA, 19 bp, Artificial Sequence
  Oligonucleotide probe
  misc_binding (1)..(19): Hybridization probe for the specific detection of wild-type HIV-1 at codon 145 of the integrase gene.
  modified_base (9)..(9): base is a locked nucleic acid
  modified_base (11)..(11): base is a locked nucleic acid
  modified_base (19)..(19): base is a locked nucleic acid
ccctacaatccccaaagyc

SEQ ID NO: 16599 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (1)..(1): base is a locked nucleic acid
cctacaatccccaaagy

SEQ ID NO: 16600 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (2)..(2): base is a locked nucleic acid
cctacaatccccaaagy

SEQ ID NO: 16601 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (8)..(8): base is a locked nucleic acid
cctacaatccccaaagy

SEQ ID NO: 16602 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (3)..(3): base is a locked nucleic acid
cctacaatccccaaagy

SEQ ID NO: 16603 - DNA, 17 bp, Artificial Sequence
  Oligonucleotide probe
  misc_binding (1)..(17): Hybridization probe for the specific detection of wild-type HIV-1 at codon 145 of the integrase gene.
cctacaatccccaaagy

SEQ ID NO: 16604 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (14)..(14): base is a locked nucleic acid
cctacaatccccaaagy

SEQ ID NO: 16605 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (13)..(13): base is a locked nucleic acid
cctacaatccccaaagy

SEQ ID NO: 16606 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (15)..(15): base is a locked nucleic acid
cctacaatccccaaagy

SEQ ID NO: 16607 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (2)..(2): base is a locked nucleic acid
  modified_base (8)..(8): base is a locked nucleic acid
  modified_base (10)..(10): base is a locked nucleic acid
cctacaatccccaaagy

SEQ ID NO: 16608 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (3)..(3): base is a locked nucleic acid
  modified_base (8)..(8): base is a locked nucleic acid
  modified_base (10)..(10): base is a locked nucleic acid
cctacaatccccaaagy

SEQ ID NO: 16609 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (7)..(7): base is a locked nucleic acid
  modified_base (8)..(8): base is a locked nucleic acid
  modified_base (10)..(10): base is a locked nucleic acid
cctacaatccccaaagy

SEQ ID NO: 16610 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (5)..(5): base is a locked nucleic acid
  modified_base (8)..(8): base is a locked nucleic acid
  modified_base (10)..(10): base is a locked nucleic acid
cctacaatccccaaagy

SEQ ID NO: 16611 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (8)..(8): base is a locked nucleic acid
  modified_base (10)..(10): base is a locked nucleic acid
  modified_base (15)..(15): base is a locked nucleic acid
cctacaatccccaaagy

SEQ ID NO: 16612 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (8)..(8): base is a locked nucleic acid
  modified_base (10)..(10): base is a locked nucleic acid
  modified_base (11)..(11): base is a locked nucleic acid
cctacaatccccaaagy

SEQ ID NO: 16613 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (8)..(8): base is a locked nucleic acid
  modified_base (10)..(10): base is a locked nucleic acid
  modified_base (14)..(14): base is a locked nucleic acid
cctacaatccccaaagy

SEQ ID NO: 16614 - DNA, 17 bp, Artificial Sequence
  Oligonucleotide probe
  misc_binding (1)..(17): Hybridization probe for the specific detection of wild-type HIV-1 at codon 145 of the integrase gene.
  modified_base (8)..(8): base is a locked nucleic acid
  modified_base (10)..(10): base is a locked nucleic acid
cctacaatccccaaagy

SEQ ID NO: 16615 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (1)..(1): base is a locked nucleic acid
cctacaatccccaaa

SEQ ID NO: 16616 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (2)..(2): base is a locked nucleic acid
cctacaatccccaaa

SEQ ID NO: 16617 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (8)..(8): base is a locked nucleic acid
cctacaatccccaaa

SEQ ID NO: 16618 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (3)..(3): base is a locked nucleic acid
cctacaatccccaaa

SEQ ID NO: 16619 - DNA, 16 bp, Artificial Sequence
  Oligonucleotide probe
  misc_binding (1)..(16): Hybridization probe for the specific detection of wild-type HIV-1 at codon 145 of the integrase gene.
cctacaatccccaaag

SEQ ID NO: 16620 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (14)..(14): base is a locked nucleic acid
cctacaatccccaaa

SEQ ID NO: 16621 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (13)..(13): base is a locked nucleic acid
cctacaatccccaaa

SEQ ID NO: 16622 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (15)..(15): base is a locked nucleic acid
cctacaatccccaaa

SEQ ID NO: 16623 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (2)..(2): base is a locked nucleic acid
  modified_base (8)..(8): base is a locked nucleic acid
  modified_base (10)..(10): base is a locked nucleic acid
cctacaatccccaaa

SEQ ID NO: 16624 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (3)..(3): base is a locked nucleic acid
  modified_base (8)..(8): base is a locked nucleic acid
  modified_base (10)..(10): base is a locked nucleic acid
cctacaatccccaaa

SEQ ID NO: 16625 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (7)..(7): base is a locked nucleic acid
  modified_base (8)..(8): base is a locked nucleic acid
  modified_base (10)..(10): base is a locked nucleic acid
cctacaatccccaaa

SEQ ID NO: 16626 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (5)..(5): base is a locked nucleic acid
  modified_base (8)..(8): base is a locked nucleic acid
  modified_base (10)..(10): base is a locked nucleic acid
cctacaatccccaaa

SEQ ID NO: 16627 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (8)..(8): base is a locked nucleic acid
  modified_base (10)..(10): base is a locked nucleic acid
  modified_base (15)..(15): base is a locked nucleic acid
cctacaatccccaaa

SEQ ID NO: 16628 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (8)..(8): base is a locked nucleic acid
  modified_base (10)..(10): base is a locked nucleic acid
  modified_base (11)..(11): base is a locked nucleic acid
cctacaatccccaaa

SEQ ID NO: 16629 - DNA, 15 bp, Artificial Sequence
  Oligonucleotide probe
  misc_binding (1)..(15): Hybridization probe for the specific detection of wild-type HIV-1 at codon 145 of the integrase gene.
  modified_base (8)..(8): base is a locked nucleic acid
  modified_base (10)..(10): base is a locked nucleic acid
  modified_base (14)..(14): base is a locked nucleic acid
cctacaatccccaaa

SEQ ID NO: 16630 - DNA, 16 bp, Artificial Sequence
  Oligonucleotide probe
  misc_binding (1)..(16): Hybridization probe for the specific detection of wild-type HIV-1 at codon 145 of the integrase gene.
  modified_base (8)..(8): base is a locked nucleic acid
  modified_base (10)..(10): base is a locked nucleic acid
cctacaatccccaaag

SEQ ID NO: 16631 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (1)..(1): base is a locked nucleic acid
cctacaatcccca

SEQ ID NO: 16632 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (2)..(2): base is a locked nucleic acid
cctacaatcccca

SEQ ID NO: 16633 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (8)..(8): base is a locked nucleic acid
cctacaatcccca

SEQ ID NO: 16634 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (3)..(3): base is a locked nucleic acid
cctacaatcccca

SEQ ID NO: 16635 - DNA, 14 bp, Artificial Sequence
  Oligonucleotide probe
  misc_binding (1)..(14): Hybridization probe for the specific detection of wild-type HIV-1 at codon 145 of the integrase gene.
cctacaatccccaa

SEQ ID NO: 16636 - DNA, 13 bp, Artificial Sequence
  Oligonucleotide probe
  misc_binding (1)..(13): Hybridization probe for the specific detection of wild-type HIV-1 at codon 145 of the integrase gene.
cctacaatcccca

SEQ ID NO: 16637 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (13)..(13): base is a locked nucleic acid
cctacaatcccca

SEQ ID NO: 16638 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (2)..(2): base is a locked nucleic acid
  modified_base (8)..(8): base is a locked nucleic acid
  modified_base (10)..(10): base is a locked nucleic acid
cctacaatcccca

SEQ ID NO: 16639 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (3)..(3): base is a locked nucleic acid
  modified_base (8)..(8): base is a locked nucleic acid
  modified_base (10)..(10): base is a locked nucleic acid
cctacaatcccca

SEQ ID NO: 16640 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (7)..(7): base is a locked nucleic acid
  modified_base (8)..(8): base is a locked nucleic acid
  modified_base (10)..(10): base is a locked nucleic acid
cctacaatcccca

SEQ ID NO: 16641 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (5)..(5): base is a locked nucleic acid
  modified_base (8)..(8): base is a locked nucleic acid
  modified_base (10)..(10): base is a locked nucleic acid
cctacaatcccca

SEQ ID NO: 16642 - DNA, 14 bp, Artificial Sequence
  Oligonucleotide probe
  misc_binding (1)..(14): Hybridization probe for the specific detection of wild-type HIV-1 at codon 145 of the integrase gene.
  modified_base (8)..(8): base is a locked nucleic acid
  modified_base (10)..(10): base is a locked nucleic acid
cctacaatccccaa

SEQ ID NO: 16643 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (8)..(8): base is a locked nucleic acid
  modified_base (10)..(10): base is a locked nucleic acid
  modified_base (11)..(11): base is a locked nucleic acid
cctacaatcccca

SEQ ID NO: 16644 - DNA, 13 bp, Artificial Sequence
  Oligonucleotide probe
  misc_binding (1)..(13): Hybridization probe for the specific detection of wild-type HIV-1 at codon 145 of the integrase gene.
  modified_base (8)..(8): base is a locked nucleic acid
  modified_base (10)..(10): base is a locked nucleic acid
cctacaatcccca

SEQ ID NO: 16645 - DNA, 19 bp, Artificial Sequence
  Oligonucleotide probe
  misc_binding (1)..(19): Hybridization probe for the specific detection of wild-type HIV-1 at codon 145 of the integrase gene.
ccctacaatccccaaagyc

SEQ ID NO: 16646 - DNA, 17 bp, Artificial Sequence
  Oligonucleotide probe
  misc_binding (1)..(17): Hybridization probe for the specific detection of wild-type HIV-1 at codon 145 of the integrase gene.
cctacaatccccaaagy

SEQ ID NO: 16647 - DNA, 15 bp, Artificial Sequence
  Oligonucleotide probe
  misc_binding (1)..(15): Hybridization probe for the specific detection of wild-type HIV-1 at codon 145 of the integrase gene.
cctacaatccccaaa

SEQ ID NO: 16648 - DNA, 13 bp, Artificial Sequence
  Oligonucleotide probe
  misc_binding (1)..(13): Hybridization probe for the specific detection of wild-type HIV-1 at codon 145 of the integrase gene.
cctacaatcccca

SEQ ID NO: 16649 - DNA, 15 bp, Artificial Sequence
  Oligonucleotide probe
  misc_binding (1)..(15): Hybridization probe for the specific detection of wild-type HIV-1 at codon 145 of the integrase gene.
tacaatccycaaagt

SEQ ID NO: 16650 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (6)..(6): base is a locked nucleic acid
acaatccccaaagycargg

SEQ ID NO: 16651 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (8)..(8): base is a locked nucleic acid
acaatccccaaagycargg

SEQ ID NO: 16652 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (5)..(5): base is a locked nucleic acid
acaatccccaaagycargg

SEQ ID NO: 16653 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (4)..(4): base is a locked nucleic acid
acaatccccaaagycargg

SEQ ID NO: 16654 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (17)..(17): base is a locked nucleic acid
acaatccccaaagycargg

SEQ ID NO: 16655 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (11)..(11): base is a locked nucleic acid
acaatccccaaagycargg

SEQ ID NO: 16656 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (16)..(16): base is a locked nucleic acid
acaatccccaaagycargg

SEQ ID NO: 16657 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (15)..(15): base is a locked nucleic acid
acaatccccaaagycargg

SEQ ID NO: 16658 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (5)..(5): base is a locked nucleic acid
  modified_base (9)..(9): base is a locked nucleic acid
  modified_base (11)..(11): base is a locked nucleic acid
acaatccccaaagycargg

SEQ ID NO: 16659 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (2)..(2): base is a locked nucleic acid
  modified_base (9)..(9): base is a locked nucleic acid
  modified_base (11)..(11): base is a locked nucleic acid
acaatccccaaagycargg

SEQ ID NO: 16660 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (3)..(3): base is a locked nucleic acid
  modified_base (9)..(9): base is a locked nucleic acid
  modified_base (11)..(11): base is a locked nucleic acid
acaatccccaaagycargg

SEQ ID NO: 16661 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (6)..(6): base is a locked nucleic acid
  modified_base (9)..(9): base is a locked nucleic acid
  modified_base (11)..(11): base is a locked nucleic acid
acaatccccaaagycargg

SEQ ID NO: 16662 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (9)..(9): base is a locked nucleic acid
  modified_base (11)..(11): base is a locked nucleic acid
  modified_base (18)..(18): base is a locked nucleic acid
acaatccccaaagycargg

SEQ ID NO: 16663 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (9)..(9): base is a locked nucleic acid
  modified_base (11)..(11): base is a locked nucleic acid
  modified_base (12)..(12): base is a locked nucleic acid
acaatccccaaagycargg

SEQ ID NO: 16664 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (9)..(9): base is a locked nucleic acid
  modified_base (11)..(11): base is a locked nucleic acid
  modified_base (15)..(15): base is a locked nucleic acid
acaatccccaaagycargg

SEQ ID NO: 16665 - DNA, 19 bp, Artificial Sequence
  Oligonucleotide probe
  misc_binding (1)..(19): Hybridization probe for the specific detection of wild-type HIV-1 at codon 146 of the integrase gene.
  modified_base (9)..(9): base is a locked nucleic acid
  modified_base (11)..(11): base is a locked nucleic acid
  modified_base (17)..(17): base is a locked nucleic acid
acaatccccaaagycargg

SEQ ID NO: 16666 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (5)..(5): base is a locked nucleic acid
caatccccaaagycarg

SEQ ID NO: 16667 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (7)..(7): base is a locked nucleic acid
caatccccaaagycarg

SEQ ID NO: 16668 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (4)..(4): base is a locked nucleic acid
caatccccaaagycarg

SEQ ID NO: 16669 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (3)..(3): base is a locked nucleic acid
caatccccaaagycarg

SEQ ID NO: 16670 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (16)..(16): base is a locked nucleic acid
caatccccaaagycarg

SEQ ID NO: 16671 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (10)..(10): base is a locked nucleic acid
caatccccaaagycarg

SEQ ID NO: 16672 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (15)..(15): base is a locked nucleic acid
caatccccaaagycarg

SEQ ID NO: 16673 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (14)..(14): base is a locked nucleic acid
caatccccaaagycarg

SEQ ID NO: 16674 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (4)..(4): base is a locked nucleic acid
  modified_base (8)..(8): base is a locked nucleic acid
  modified_base (10)..(10): base is a locked nucleic acid
caatccccaaagycarg

SEQ ID NO: 16675 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (1)..(1): base is a locked nucleic acid
  modified_base (8)..(8): base is a locked nucleic acid
  modified_base (10)..(10): base is a locked nucleic acid
caatccccaaagycarg

SEQ ID NO: 16676 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (2)..(2): base is a locked nucleic acid
  modified_base (8)..(8): base is a locked nucleic acid
  modified_base (10)..(10): base is a locked nucleic acid
caatccccaaagycarg

SEQ ID NO: 16677 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (5)..(5): base is a locked nucleic acid
  modified_base (8)..(8): base is a locked nucleic acid
  modified_base (10)..(10): base is a locked nucleic acid
caatccccaaagycarg

SEQ ID NO: 16678 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (8)..(8): base is a locked nucleic acid
  modified_base (10)..(10): base is a locked nucleic acid
  modified_base (17)..(17): base is a locked nucleic acid
caatccccaaagycarg

SEQ ID NO: 16679 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (8)..(8): base is a locked nucleic acid
  modified_base (10)..(10): base is a locked nucleic acid
  modified_base (11)..(11): base is a locked nucleic acid
caatccccaaagycarg

SEQ ID NO: 16680 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (8)..(8): base is a locked nucleic acid
  modified_base (10)..(10): base is a locked nucleic acid
  modified_base (14)..(14): base is a locked nucleic acid
caatccccaaagycarg

SEQ ID NO: 16681 - DNA, 17 bp, Artificial Sequence
  Oligonucleotide probe
  misc_binding (1)..(17): Hybridization probe for the specific detection of wild-type HIV-1 at codon 146 of the integrase gene.
  modified_base (8)..(8): base is a locked nucleic acid
  modified_base (10)..(10): base is a locked nucleic acid
  modified_base (16)..(16): base is a locked nucleic acid
caatccccaaagycarg

SEQ ID NO: 16682 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (5)..(5): base is a locked nucleic acid
caatccccaaagyca

SEQ ID NO: 16683 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (7)..(7): base is a locked nucleic acid
caatccccaaagyca

SEQ ID NO: 16684 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (4)..(4): base is a locked nucleic acid
caatccccaaagyca

SEQ ID NO: 16685 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (3)..(3): base is a locked nucleic acid
caatccccaaagyca

SEQ ID NO: 16686 - DNA, 15 bp, Artificial Sequence
  Oligonucleotide probe
  misc_binding (1)..(15): Hybridization probe for the specific detection of wild-type HIV-1 at codon 146 of the integrase gene.
caatccccaaagyca

SEQ ID NO: 16687 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (10)..(10): base is a locked nucleic acid
caatccccaaagyca

SEQ ID NO: 16688 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (15)..(15): base is a locked nucleic acid
caatccccaaagyca

SEQ ID NO: 16689 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (14)..(14): base is a locked nucleic acid
caatccccaaagyca

SEQ ID NO: 16690 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (4)..(4): base is a locked nucleic acid
  modified_base (8)..(8): base is a locked nucleic acid
  modified_base (10)..(10): base is a locked nucleic acid
caatccccaaagyca

SEQ ID NO: 16691 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (1)..(1): base is a locked nucleic acid
  modified_base (8)..(8): base is a locked nucleic acid
  modified_base (10)..(10): base is a locked nucleic acid
caatccccaaagyca

SEQ ID NO: 16692 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (2)..(2): base is a locked nucleic acid
  modified_base (8)..(8): base is a locked nucleic acid
  modified_base (10)..(10): base is a locked nucleic acid
caatccccaaagyca

SEQ ID NO: 16693 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (5)..(5): base is a locked nucleic acid
  modified_base (8)..(8): base is a locked nucleic acid
  modified_base (10)..(10): base is a locked nucleic acid
caatccccaaagyca

SEQ ID NO: 16694 - DNA, 16 bp, Artificial Sequence
  Oligonucleotide probe
  misc_binding (1)..(16): Hybridization probe for the specific detection of wild-type HIV-1 at codon 146 of the integrase gene.
  modified_base (8)..(8): base is a locked nucleic acid
  modified_base (10)..(10): base is a locked nucleic acid
caatccccaaagycar

SEQ ID NO: 16695 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (8)..(8): base is a locked nucleic acid
  modified_base (10)..(10): base is a locked nucleic acid
  modified_base (11)..(11): base is a locked nucleic acid
caatccccaaagyca

SEQ ID NO: 16696 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (8)..(8): base is a locked nucleic acid
  modified_base (10)..(10): base is a locked nucleic acid
  modified_base (14)..(14): base is a locked nucleic acid
caatccccaaagyca

SEQ ID NO: 16697 - DNA, 15 bp, Artificial Sequence
  Oligonucleotide probe
  misc_binding (1)..(15): Hybridization probe for the specific detection of wild-type HIV-1 at codon 146 of the integrase gene.
  modified_base (8)..(8): base is a locked nucleic acid
  modified_base (10)..(10): base is a locked nucleic acid
caatccccaaagyca

SEQ ID NO: 16698 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (5)..(5): base is a locked nucleic acid
caatccccaaagy

SEQ ID NO: 16699 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (7)..(7): base is a locked nucleic acid
caatccccaaagy

SEQ ID NO: 16700 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (4)..(4): base is a locked nucleic acid
caatccccaaagy

SEQ ID NO: 16701 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (3)..(3): base is a locked nucleic acid
caatccccaaagy

SEQ ID NO: 16702 - DNA, 14 bp, Artificial Sequence
  Oligonucleotide probe
  misc_binding (1)..(14): Hybridization probe for the specific detection of wild-type HIV-1 at codon 146 of the integrase gene.
caatccccaaagyc

SEQ ID NO: 16703 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (10)..(10): base is a locked nucleic acid
caatccccaaagy

SEQ ID NO: 16704 - DNA, 13 bp, Artificial Sequence
  Oligonucleotide probe
  misc_binding (1)..(13): Hybridization probe for the specific detection of wild-type HIV-1 at codon 146 of the integrase gene.
caatccccaaagy

SEQ ID NO: 16705 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (4)..(4): base is a locked nucleic acid
  modified_base (8)..(8): base is a locked nucleic acid
  modified_base (10)..(10): base is a locked nucleic acid
caatccccaaagy

SEQ ID NO: 16706 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (1)..(1): base is a locked nucleic acid
  modified_base (8)..(8): base is a locked nucleic acid
  modified_base (10)..(10): base is a locked nucleic acid
caatccccaaagy

SEQ ID NO: 16707 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (2)..(2): base is a locked nucleic acid
  modified_base (8)..(8): base is a locked nucleic acid
  modified_base (10)..(10): base is a locked nucleic acid
caatccccaaagy

SEQ ID NO: 16708 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (5)..(5): base is a locked nucleic acid
  modified_base (8)..(8): base is a locked nucleic acid
  modified_base (10)..(10): base is a locked nucleic acid
caatccccaaagy

SEQ ID NO: 16709 - DNA, 14 bp, Artificial Sequence
  Oligonucleotide probe
  misc_binding (1)..(14): Hybridization probe for the specific detection of wild-type HIV-1 at codon 146 of the integrase gene.
  modified_base (8)..(8): base is a locked nucleic acid
  modified_base (10)..(10): base is a locked nucleic acid
caatccccaaagyc

SEQ ID NO: 16710 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (8)..(8): base is a locked nucleic acid
  modified_base (10)..(10): base is a locked nucleic acid
  modified_base (11)..(11): base is a locked nucleic acid
caatccccaaagy

SEQ ID NO: 16711 - DNA, 13 bp, Artificial Sequence
  Oligonucleotide probe
  misc_binding (1)..(13): Hybridization probe for the specific detection of wild-type HIV-1 at codon 146 of the integrase gene.
  modified_base (8)..(8): base is a locked nucleic acid
  modified_base (10)..(10): base is a locked nucleic acid
caatccccaaagy

SEQ ID NO: 16712 - DNA, 19 bp, Artificial Sequence
  Oligonucleotide probe
  misc_binding (1)..(19): Hybridization probe for the specific detection of wild-type HIV-1 at codon 146 of the integrase gene.
acaatccccaaagycargg

SEQ ID NO: 16713 - DNA, 17 bp, Artificial Sequence
  Oligonucleotide probe
  misc_binding (1)..(17): Hybridization probe for the specific detection of wild-type HIV-1 at codon 146 of the integrase gene.
caatccccaaagycarg

SEQ ID NO: 16714 - DNA, 15 bp, Artificial Sequence
  Oligonucleotide probe
  misc_binding (1)..(15): Hybridization probe for the specific detection of wild-type HIV-1 at codon 146 of the integrase gene.
caatccccaaagyca

SEQ ID NO: 16715 - DNA, 16 bp, Artificial Sequence
  Oligonucleotide probe
  misc_binding (1)..(16): Hybridization probe for the specific detection of wild-type HIV-1 at codon 146 of the integrase gene.
caatccccaaagycar

SEQ ID NO: 16716 - DNA, 13 bp, Artificial Sequence
  Oligonucleotide probe
  misc_binding (1)..(13): Hybridization probe for the specific detection of wild-type HIV-1 at codon 146 of the integrase gene.
caatccccaaagy

SEQ ID NO: 16717 - DNA, 15 bp, Artificial Sequence
  Oligonucleotide probe
  misc_binding (1)..(15): Hybridization probe for the specific detection of wild-type HIV-1 at codon 146 of the integrase gene.
aatccccaragtcaa

SEQ ID NO: 16718 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (8)..(8): base is a locked nucleic acid
aatccccaaagycarggag

SEQ ID NO: 16719 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (4)..(4): base is a locked nucleic acid
aatccccaaagycarggag

SEQ ID NO: 16720 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (7)..(7): base is a locked nucleic acid
aatccccaaagycarggag

SEQ ID NO: 16721 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (6)..(6): base is a locked nucleic acid
aatccccaaagycarggag

SEQ ID NO: 16722 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (17)..(17): base is a locked nucleic acid
aatccccaaagycarggag

SEQ ID NO: 16723 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (18)..(18): base is a locked nucleic acid
aatccccaaagycarggag

SEQ ID NO: 16724 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (19)..(19): base is a locked nucleic acid
aatccccaaagycarggag

SEQ ID NO: 16725 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (13)..(13): base is a locked nucleic acid
aatccccaaagycarggag

SEQ ID NO: 16726 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (2)..(2): base is a locked nucleic acid
  modified_base (9)..(9): base is a locked nucleic acid
  modified_base (11)..(11): base is a locked nucleic acid
aatccccaaagycarggag

SEQ ID NO: 16727 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (7)..(7): base is a locked nucleic acid
  modified_base (9)..(9): base is a locked nucleic acid
  modified_base (11)..(11): base is a locked nucleic acid
aatccccaaagycarggag

SEQ ID NO: 16728 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (5)..(5): base is a locked nucleic acid
  modified_base (9)..(9): base is a locked nucleic acid
  modified_base (11)..(11): base is a locked nucleic acid
aatccccaaagycarggag

SEQ ID NO: 16729 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (4)..(4): base is a locked nucleic acid
  modified_base (9)..(9): base is a locked nucleic acid
  modified_base (11)..(11): base is a locked nucleic acid
aatccccaaagycarggag

SEQ ID NO: 16730 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (9)..(9): base is a locked nucleic acid
  modified_base (11)..(11): base is a locked nucleic acid
  modified_base (15)..(15): base is a locked nucleic acid
aatccccaaagycarggag

SEQ ID NO: 16731 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (9)..(9): base is a locked nucleic acid
  modified_base (11)..(11): base is a locked nucleic acid
  modified_base (12)..(12): base is a locked nucleic acid
aatccccaaagycarggag

SEQ ID NO: 16732 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (9)..(9): base is a locked nucleic acid
  modified_base (11)..(11): base is a locked nucleic acid
  modified_base (13)..(13): base is a locked nucleic acid
aatccccaaagycarggag

SEQ ID NO: 16733 - DNA, 19 bp, Artificial Sequence
  Oligonucleotide probe
  misc_binding (1)..(19): Hybridization probe for the specific detection of wild-type HIV-1 at codon 147 of the integrase gene.
  modified_base (9)..(9): base is a locked nucleic acid
  modified_base (11)..(11): base is a locked nucleic acid
  modified_base (18)..(18): base is a locked nucleic acid
aatccccaaagycarggag

SEQ ID NO: 16734 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (7)..(7): base is a locked nucleic acid
atccccaaagycargga

SEQ ID NO: 16735 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (3)..(3): base is a locked nucleic acid
atccccaaagycargga

SEQ ID NO: 16736 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (6)..(6): base is a locked nucleic acid
atccccaaagycargga

SEQ ID NO: 16737 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (5)..(5): base is a locked nucleic acid
atccccaaagycargga

SEQ ID NO: 16738 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (16)..(16): base is a locked nucleic acid
atccccaaagycargga

SEQ ID NO: 16739 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (17)..(17): base is a locked nucleic acid
atccccaaagycargga

SEQ ID NO: 16740 - DNA, 17 bp, Artificial Sequence
  Oligonucleotide probe
  misc_binding (1)..(17): Hybridization probe for the specific detection of wild-type HIV-1 at codon 147 of the integrase gene.
atccccaaagycargga

SEQ ID NO: 16741 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (12)..(12): base is a locked nucleic acid
atccccaaagycargga

SEQ ID NO: 16742 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (1)..(1): base is a locked nucleic acid
  modified_base (8)..(8): base is a locked nucleic acid
  modified_base (10)..(10): base is a locked nucleic acid
atccccaaagycargga

SEQ ID NO: 16743 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (6)..(6): base is a locked nucleic acid
  modified_base (8)..(8): base is a locked nucleic acid
  modified_base (10)..(10): base is a locked nucleic acid
atccccaaagycargga

SEQ ID NO: 16744 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (4)..(4): base is a locked nucleic acid
  modified_base (8)..(8): base is a locked nucleic acid
  modified_base (10)..(10): base is a locked nucleic acid
atccccaaagycargga

SEQ ID NO: 16745 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (3)..(3): base is a locked nucleic acid
  modified_base (8)..(8): base is a locked nucleic acid
  modified_base (10)..(10): base is a locked nucleic acid
atccccaaagycargga

SEQ ID NO: 16746 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (14)..(14): base is a locked nucleic acid
atccccaaagycargga

SEQ ID NO: 16747 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (11)..(11): base is a locked nucleic acid
atccccaaagycargga

SEQ ID NO: 16748 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (12)..(12): base is a locked nucleic acid
atccccaaagycargga

SEQ ID NO: 16749 - DNA, 17 bp, Artificial Sequence
  Oligonucleotide probe
  misc_binding (1)..(17): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (17)..(17): base is a locked nucleic acid
atccccaaagycargga

SEQ ID NO: 16750 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (7)..(7): base is a locked nucleic acid
atccccaaagycarg

SEQ ID NO: 16751 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (3)..(3): base is a locked nucleic acid
atccccaaagycarg

SEQ ID NO: 16752 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (6)..(6): base is a locked nucleic acid
atccccaaagycarg

SEQ ID NO: 16753 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (5)..(5): base is a locked nucleic acid
atccccaaagycarg

SEQ ID NO: 16754 - DNA, 15 bp, Artificial Sequence
  Oligonucleotide probe
  misc_binding (1)..(15): Hybridization probe for the specific detection of wild-type HIV-1 at codon 147 of the integrase gene.
atccccaaagycarg

SEQ ID NO: 16755 - DNA, 16 bp, Artificial Sequence
  Oligonucleotide probe
  misc_binding (1)..(16): Hybridization probe for the specific detection of wild-type HIV-1 at codon 147 of the integrase gene.
atccccaaagycargg

SEQ ID NO: 16756 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (12)..(12): base is a locked nucleic acid
atccccaaagycarg

SEQ ID NO: 16757 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (1)..(1): base is a locked nucleic acid
  modified_base (8)..(8): base is a locked nucleic acid
  modified_base (10)..(10): base is a locked nucleic acid
atccccaaagycarg

SEQ ID NO: 16758 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (6)..(6): base is a locked nucleic acid
  modified_base (8)..(8): base is a locked nucleic acid
  modified_base (10)..(10): base is a locked nucleic acid
atccccaaagycarg

SEQ ID NO: 16759 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (4)..(4): base is a locked nucleic acid
  modified_base (8)..(8): base is a locked nucleic acid
  modified_base (10)..(10): base is a locked nucleic acid
atccccaaagycarg

SEQ ID NO: 16760 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (3)..(3): base is a locked nucleic acid
  modified_base (8)..(8): base is a locked nucleic acid
  modified_base (10)..(10): base is a locked nucleic acid
atccccaaagycarg

SEQ ID NO: 16761 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (14)..(14): base is a locked nucleic acid
atccccaaagycarg

SEQ ID NO: 16762 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (11)..(11): base is a locked nucleic acid
atccccaaagycarg

SEQ ID NO: 16763 - DNA, 15 bp, Artificial Sequence
  Oligonucleotide probe
  misc_binding (1)..(15): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (12)..(12): base is a locked nucleic acid
atccccaaagycarg

SEQ ID NO: 16764 - DNA, 16 bp, Artificial Sequence
  Oligonucleotide probe
  misc_binding (1)..(16): Hybridization probe for the specific detection of wild-type HIV-1 at codon 147 of the integrase gene.
  modified_base (8)..(8): base is a locked nucleic acid
  modified_base (10)..(10): base is a locked nucleic acid
atccccaaagycargg

SEQ ID NO: 16765 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (7)..(7): base is a locked nucleic acid
atccccaaagyca

SEQ ID NO: 16766 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (3)..(3): base is a locked nucleic acid
atccccaaagyca

SEQ ID NO: 16767 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (6)..(6): base is a locked nucleic acid
atccccaaagyca

SEQ ID NO: 16768 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (5)..(5): base is a locked nucleic acid
atccccaaagyca

SEQ ID NO: 16769 - DNA, 14 bp, Artificial Sequence
  Oligonucleotide probe
  misc_binding (1)..(14): Hybridization probe for the specific detection of wild-type HIV-1 at codon 147 of the integrase gene.
atccccaaagycar

SEQ ID NO: 16770 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (12)..(12): base is a locked nucleic acid
atccccaaagyca

SEQ ID NO: 16771 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (1)..(1): base is a locked nucleic acid
  modified_base (8)..(8): base is a locked nucleic acid
  modified_base (10)..(10): base is a locked nucleic acid
atccccaaagyca

SEQ ID NO: 16772 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (6)..(6): base is a locked nucleic acid
  modified_base (8)..(8): base is a locked nucleic acid
  modified_base (10)..(10): base is a locked nucleic acid
atccccaaagyca

SEQ ID NO: 16773 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (4)..(4): base is a locked nucleic acid
  modified_base (8)..(8): base is a locked nucleic acid
  modified_base (10)..(10): base is a locked nucleic acid
atccccaaagyca

SEQ ID NO: 16774 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (3)..(3): base is a locked nucleic acid
  modified_base (8)..(8): base is a locked nucleic acid
  modified_base (10)..(10): base is a locked nucleic acid
atccccaaagyca

SEQ ID NO: 16775 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (8)..(8): base is a locked nucleic acid
  modified_base (10)..(10): base is a locked nucleic acid
atccccaaagyca

SEQ ID NO: 16776 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (11)..(11): base is a locked nucleic acid
atccccaaagyca

SEQ ID NO: 16777 - DNA, 13 bp, Artificial Sequence
  Oligonucleotide probe
  misc_binding (1)..(13): Hybridization probe for the specific detection of wild-type HIV-1 at codon 147 of the integrase gene.
  modified_base (8)..(8): base is a locked nucleic acid
  modified_base (10)..(10): base is a locked nucleic acid
  modified_base (12)..(12): base is a locked nucleic acid
atccccaaagyca

SEQ ID NO: 16778 - DNA, 14 bp, Artificial Sequence
  Oligonucleotide probe
  misc_binding (1)..(14): Hybridization probe for the specific detection of wild-type HIV-1 at codon 147 of the integrase gene.
  modified_base (8)..(8): base is a locked nucleic acid
  modified_base (10)..(10): base is a locked nucleic acid
atccccaaagycar

SEQ ID NO: 16779 - DNA, 19 bp, Artificial Sequence
  Oligonucleotide probe
  misc_binding (1)..(19): Hybridization probe for the specific detection of wild-type HIV-1 at codon 147 of the integrase gene.
aatccccaaagycarggag

SEQ ID NO: 16780 - DNA, 17 bp, Artificial Sequence
  Oligonucleotide probe
  misc_binding (1)..(17): Hybridization probe for the specific detection of wild-type HIV-1 at codon 147 of the integrase gene.
atccccaaagycargga

SEQ ID NO: 16781 - DNA, 15 bp, Artificial Sequence
  Oligonucleotide probe
  misc_binding (1)..(15): Hybridization probe for the specific detection of wild-type HIV-1 at codon 147 of the integrase gene.
atccccaaagycarg

SEQ ID NO: 16782 - DNA, 13 bp, Artificial Sequence
  Oligonucleotide probe
  misc_binding (1)..(13): Hybridization probe for the specific detection of wild-type HIV-1 at codon 147 of the integrase gene.
atccccaaagyca

SEQ ID NO: 16783 - DNA, 15 bp, Artificial Sequence
  Oligonucleotide probe
  misc_binding (1)..(15): Hybridization probe for the specific detection of wild-type HIV-1 at codon 147 of the integrase gene.
tccccaaagycaagg

SEQ ID NO: 16784 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (6)..(6): base is a locked nucleic acid
ccaaagycarggagtagtr

SEQ ID NO: 16785 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (4)..(4): base is a locked nucleic acid
ccaaagycarggagtagtr

SEQ ID NO: 16786 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (2)..(2): base is a locked nucleic acid
ccaaagycarggagtagtr

SEQ ID NO: 16787 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (3)..(3): base is a locked nucleic acid
ccaaagycarggagtagtr

SEQ ID NO: 16788 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (16)..(16): base is a locked nucleic acid
ccaaagycarggagtagtr

SEQ ID NO: 16789 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (17)..(17): base is a locked nucleic acid
ccaaagycarggagtagtr

SEQ ID NO: 16790 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (14)..(14): base is a locked nucleic acid
ccaaagycarggagtagtr

SEQ ID NO: 16791 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (12)..(12): base is a locked nucleic acid
ccaaagycarggagtagtr

SEQ ID NO: 16792 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
ccaaagycarggagtagtr

SEQ ID NO: 16793 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (4)..(4): base is a locked nucleic acid
  modified_base (9)..(9): base is a locked nucleic acid
  modified_base (11)..(11): base is a locked nucleic acid
ccaaagycarggagtagtr

SEQ ID NO: 16794 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (3)..(3): base is a locked nucleic acid
  modified_base (9)..(9): base is a locked nucleic acid
  modified_base (11)..(11): base is a locked nucleic acid
ccaaagycarggagtagtr

SEQ ID NO: 16795 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (5)..(5): base is a locked nucleic acid
  modified_base (9)..(9): base is a locked nucleic acid
  modified_base (11)..(11): base is a locked nucleic acid
ccaaagycarggagtagtr

SEQ ID NO: 16796 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (13)..(13): base is a locked nucleic acid
ccaaagycarggagtagtr

SEQ ID NO: 16797 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (15)..(15): base is a locked nucleic acid
ccaaagycarggagtagtr

SEQ ID NO: 16798 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (19)..(19): base is a locked nucleic acid
ccaaagycarggagtagtr

SEQ ID NO: 16799 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (16)..(16): base is a locked nucleic acid
ccaaagycarggagtagtr

SEQ ID NO: 16800 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (4)..(4): base is a locked nucleic acid
ccccaaagycarggagtag

SEQ ID NO: 16801 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (6)..(6): base is a locked nucleic acid
ccccaaagycarggagtag

SEQ ID NO: 16802 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
ccccaaagycarggagtag

SEQ ID NO: 16803 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (8)..(8): base is a locked nucleic acid
ccccaaagycarggagtag

SEQ ID NO: 16804 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (17)..(17): base is a locked nucleic acid
ccccaaagycarggagtag

SEQ ID NO: 16805 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (14)..(14): base is a locked nucleic acid
ccccaaagycarggagtag

SEQ ID NO: 16806 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (11)..(11): base is a locked nucleic acid
ccccaaagycarggagtag

SEQ ID NO: 16807 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (13)..(13): base is a locked nucleic acid
ccccaaagycarggagtag

SEQ ID NO: 16808 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (4)..(4): base is a locked nucleic acid
  modified_base (9)..(9): base is a locked nucleic acid
  modified_base (11)..(11): base is a locked nucleic acid
ccccaaagycarggagtag

SEQ ID NO: 16809 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (6)..(6): base is a locked nucleic acid
  modified_base (9)..(9): base is a locked nucleic acid
  modified_base (11)..(11): base is a locked nucleic acid
ccccaaagycarggagtag

SEQ ID NO: 16810 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (3)..(3): base is a locked nucleic acid
  modified_base (9)..(9): base is a locked nucleic acid
  modified_base (11)..(11): base is a locked nucleic acid
ccccaaagycarggagtag

SEQ ID NO: 16811 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (5)..(5): base is a locked nucleic acid
  modified_base (9)..(9): base is a locked nucleic acid
  modified_base (11)..(11): base is a locked nucleic acid
ccccaaagycarggagtag

SEQ ID NO: 16812 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (13)..(13): base is a locked nucleic acid
ccccaaagycarggagtag

SEQ ID NO: 16813 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (16)..(16): base is a locked nucleic acid
ccccaaagycarggagtag

SEQ ID NO: 16814 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (17)..(17): base is a locked nucleic acid
ccccaaagycarggagtag

SEQ ID NO: 16815 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (19)..(19): base is a locked nucleic acid
ccccaaagycarggagtag

SEQ ID NO: 16816 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (6)..(6): base is a locked nucleic acid
cccaaagycarggagtagt

SEQ ID NO: 16817 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (4)..(4): base is a locked nucleic acid
cccaaagycarggagtagt

SEQ ID NO: 16818 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (8)..(8): base is a locked nucleic acid
cccaaagycarggagtagt

SEQ ID NO: 16819 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
cccaaagycarggagtagt

SEQ ID NO: 16820 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (16)..(16): base is a locked nucleic acid
cccaaagycarggagtagt

SEQ ID NO: 16821 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (18)..(18): base is a locked nucleic acid
cccaaagycarggagtagt

SEQ ID NO: 16822 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (14)..(14): base is a locked nucleic acid
cccaaagycarggagtagt

SEQ ID NO: 16823 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (12)..(12): base is a locked nucleic acid
cccaaagycarggagtagt

SEQ ID NO: 16824 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
cccaaagycarggagtagt

SEQ ID NO: 16825 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (3)..(3): base is a locked nucleic acid
  modified_base (9)..(9): base is a locked nucleic acid
  modified_base (11)..(11): base is a locked nucleic acid
cccaaagycarggagtagt

SEQ ID NO: 16826 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (7)..(7): base is a locked nucleic acid
  modified_base (9)..(9): base is a locked nucleic acid
  modified_base (11)..(11): base is a locked nucleic acid
cccaaagycarggagtagt

SEQ ID NO: 16827 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (2)..(2): base is a locked nucleic acid
  modified_base (9)..(9): base is a locked nucleic acid
  modified_base (11)..(11): base is a locked nucleic acid
cccaaagycarggagtagt

SEQ ID NO: 16828 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (14)..(14): base is a locked nucleic acid
cccaaagycarggagtagt

SEQ ID NO: 16829 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (12)..(12): base is a locked nucleic acid
cccaaagycarggagtagt

SEQ ID NO: 16830 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (16)..(16): base is a locked nucleic acid
cccaaagycarggagtagt

SEQ ID NO: 16831 - DNA, 19 bp, Artificial Sequence
  Oligonucleotide probe
  misc_binding (1)..(19): Hybridization probe for the specific detection of wild-type HIV-1 at codon 148 of the integrase gene.
  modified_base (9)..(9): base is a locked nucleic acid
  modified_base (11)..(11): base is a locked nucleic acid
  modified_base (17)..(17): base is a locked nucleic acid
cccaaagycarggagtagt

SEQ ID NO: 16832 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (5)..(5): base is a locked nucleic acid
caaagycarggagtagt

SEQ ID NO: 16833 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (3)..(3): base is a locked nucleic acid
caaagycarggagtagt

SEQ ID NO: 16834 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (1)..(1): base is a locked nucleic acid
caaagycarggagtagt

SEQ ID NO: 16835 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (2)..(2): base is a locked nucleic acid
caaagycarggagtagt

SEQ ID NO: 16836 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (15)..(15): base is a locked nucleic acid
caaagycarggagtagt

SEQ ID NO: 16837 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (16)..(16): base is a locked nucleic acid
caaagycarggagtagt

SEQ ID NO: 16838 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (13)..(13): base is a locked nucleic acid
caaagycarggagtagt

SEQ ID NO: 16839 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (11)..(11): base is a locked nucleic acid
caaagycarggagtagt

SEQ ID NO: 16840 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (7)..(7): base is a locked nucleic acid
  modified_base (8)..(8): base is a locked nucleic acid
  modified_base (10)..(10): base is a locked nucleic acid
caaagycarggagtagt

SEQ ID NO: 16841 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (3)..(3): base is a locked nucleic acid
  modified_base (8)..(8): base is a locked nucleic acid
  modified_base (10)..(10): base is a locked nucleic acid
caaagycarggagtagt

SEQ ID NO: 16842 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
caaagycarggagtagt

SEQ ID NO: 16843 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (4)..(4): base is a locked nucleic acid
  modified_base (8)..(8): base is a locked nucleic acid
  modified_base (10)..(10): base is a locked nucleic acid
caaagycarggagtagt

SEQ ID NO: 16844 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (12)..(12): base is a locked nucleic acid
caaagycarggagtagt

SEQ ID NO: 16845 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (14)..(14): base is a locked nucleic acid
caaagycarggagtagt

SEQ ID NO: 16846 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
caaagycarggagtagt

SEQ ID NO: 16847 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (15)..(15): base is a locked nucleic acid
caaagycarggagtagt

SEQ ID NO: 16848 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (3)..(3): base is a locked nucleic acid
cccaaagycarggagta

SEQ ID NO: 16849 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (5)..(5): base is a locked nucleic acid
cccaaagycarggagta

SEQ ID NO: 16850 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
cccaaagycarggagta

SEQ ID NO: 16851 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (7)..(7): base is a locked nucleic acid
cccaaagycarggagta

SEQ ID NO: 16852 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (16)..(16): base is a locked nucleic acid
cccaaagycarggagta

SEQ ID NO: 16853 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (13)..(13): base is a locked nucleic acid
cccaaagycarggagta

SEQ ID NO: 16854 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (10)..(10): base is a locked nucleic acid
cccaaagycarggagta

SEQ ID NO: 16855 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (12)..(12): base is a locked nucleic acid
cccaaagycarggagta

SEQ ID NO: 16856 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (3)..(3): base is a locked nucleic acid
  modified_base (8)..(8): base is a locked nucleic acid
  modified_base (10)..(10): base is a locked nucleic acid
cccaaagycarggagta

SEQ ID NO: 16857 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (5)..(5): base is a locked nucleic acid
  modified_base (8)..(8): base is a locked nucleic acid
  modified_base (10)..(10): base is a locked nucleic acid
cccaaagycarggagta

SEQ ID NO: 16858 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
cccaaagycarggagta

SEQ ID NO: 16859 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (4)..(4): base is a locked nucleic acid
  modified_base (8)..(8): base is a locked nucleic acid
  modified_base (10)..(10): base is a locked nucleic acid
cccaaagycarggagta

SEQ ID NO: 16860 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (12)..(12): base is a locked nucleic acid
cccaaagycarggagta

SEQ ID NO: 16861 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (15)..(15): base is a locked nucleic acid
cccaaagycarggagta

SEQ ID NO: 16862 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (16)..(16): base is a locked nucleic acid
cccaaagycarggagta

SEQ ID NO: 16863 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
cccaaagycarggagta

SEQ ID NO: 16864 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (5)..(5): base is a locked nucleic acid
ccaaagycarggagtag

SEQ ID NO: 16865 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (3)..(3): base is a locked nucleic acid
ccaaagycarggagtag

SEQ ID NO: 16866 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (7)..(7): base is a locked nucleic acid
ccaaagycarggagtag

SEQ ID NO: 16867 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
ccaaagycarggagtag

SEQ ID NO: 16868 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (15)..(15): base is a locked nucleic acid
ccaaagycarggagtag

SEQ ID NO: 16869 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (17)..(17): base is a locked nucleic acid
ccaaagycarggagtag

SEQ ID NO: 16870 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (13)..(13): base is a locked nucleic acid
ccaaagycarggagtag

SEQ ID NO: 16871 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (11)..(11): base is a locked nucleic acid
ccaaagycarggagtag

SEQ ID NO: 16872 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (7)..(7): base is a locked nucleic acid
  modified_base (8)..(8): base is a locked nucleic acid
  modified_base (10)..(10): base is a locked nucleic acid
ccaaagycarggagtag

SEQ ID NO: 16873 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
ccaaagycarggagtag

SEQ ID NO: 16874 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (6)..(6): base is a locked nucleic acid
  modified_base (8)..(8): base is a locked nucleic acid
  modified_base (10)..(10): base is a locked nucleic acid
ccaaagycarggagtag

SEQ ID NO: 16875 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (1)..(1): base is a locked nucleic acid
  modified_base (8)..(8): base is a locked nucleic acid
  modified_base (10)..(10): base is a locked nucleic acid
ccaaagycarggagtag

SEQ ID NO: 16876 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (13)..(13): base is a locked nucleic acid
ccaaagycarggagtag

SEQ ID NO: 16877 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (11)..(11): base is a locked nucleic acid
ccaaagycarggagtag

SEQ ID NO: 16878 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (15)..(15): base is a locked nucleic acid
ccaaagycarggagtag

SEQ ID NO: 16879 - DNA, 17 bp, Artificial Sequence
  Oligonucleotide probe
  misc_binding (1)..(17): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (16)..(16): base is a locked nucleic acid
ccaaagycarggagtag

SEQ ID NO: 16880 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (5)..(5): base is a locked nucleic acid
caaagycarggagta

SEQ ID NO: 16881 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (3)..(3): base is a locked nucleic acid
caaagycarggagta

SEQ ID NO: 16882 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (1)..(1): base is a locked nucleic acid
caaagycarggagta

SEQ ID NO: 16883 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (2)..(2): base is a locked nucleic acid
caaagycarggagta

SEQ ID NO: 16884 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (15)..(15): base is a locked nucleic acid
caaagycarggagta

SEQ ID NO: 16885 - DNA, 15 bp, Artificial Sequence
  Oligonucleotide probe
  misc_binding (1)..(15): Hybridization probe for the specific detection of wild-type HIV-1 at codon 148 of the integrase gene.
caaagycarggagta

SEQ ID NO: 16886 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (13)..(13): base is a locked nucleic acid
caaagycarggagta

SEQ ID NO: 16887 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (11)..(11): base is a locked nucleic acid
caaagycarggagta

SEQ ID NO: 16888 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (7)..(7): base is a locked nucleic acid
  modified_base (8)..(8): base is a locked nucleic acid
  modified_base (10)..(10): base is a locked nucleic acid
caaagycarggagta

SEQ ID NO: 16889 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (3)..(3): base is a locked nucleic acid
  modified_base (8)..(8): base is a locked nucleic acid
  modified_base (10)..(10): base is a locked nucleic acid
caaagycarggagta

SEQ ID NO: 16890 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
caaagycarggagta

SEQ ID NO: 16891 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (4)..(4): base is a locked nucleic acid
  modified_base (8)..(8): base is a locked nucleic acid
  modified_base (10)..(10): base is a locked nucleic acid
caaagycarggagta

SEQ ID NO: 16892 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (12)..(12): base is a locked nucleic acid
caaagycarggagta

SEQ ID NO: 16893 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (14)..(14): base is a locked nucleic acid
caaagycarggagta

SEQ ID NO: 16894 - DNA, 16 bp, Artificial Sequence
  Oligonucleotide probe
  misc_binding (1)..(16): Hybridization probe for the specific detection of wild-type HIV-1 at codon 148 of the integrase gene.
  modified_base (8)..(8): base is a locked nucleic acid
  modified_base (10)..(10): base is a locked nucleic acid
caaagycarggagtag

SEQ ID NO: 16895 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (15)..(15): base is a locked nucleic acid
caaagycarggagta

SEQ ID NO: 16896 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (3)..(3): base is a locked nucleic acid
cccaaagycarggag

SEQ ID NO: 16897 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (5)..(5): base is a locked nucleic acid
cccaaagycarggag

SEQ ID NO: 16898 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
cccaaagycarggag

SEQ ID NO: 16899 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (7)..(7): base is a locked nucleic acid
cccaaagycarggag

SEQ ID NO: 16900 - DNA, 15 bp, Artificial Sequence
  Oligonucleotide probe
  misc_binding (1)..(15): Hybridization probe for the specific detection of wild-type HIV-1 at codon 148 of the integrase gene.
cccaaagycarggag

SEQ ID NO: 16901 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (13)..(13): base is a locked nucleic acid
cccaaagycarggag

SEQ ID NO: 16902 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (10)..(10): base is a locked nucleic acid
cccaaagycarggag

SEQ ID NO: 16903 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (12)..(12): base is a locked nucleic acid
cccaaagycarggag

SEQ ID NO: 16904 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (3)..(3): base is a locked nucleic acid
  modified_base (8)..(8): base is a locked nucleic acid
  modified_base (10)..(10): base is a locked nucleic acid
cccaaagycarggag

SEQ ID NO: 16905 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (5)..(5): base is a locked nucleic acid
  modified_base (8)..(8): base is a locked nucleic acid
  modified_base (10)..(10): base is a locked nucleic acid
cccaaagycarggag

SEQ ID NO: 16906 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
cccaaagycarggag

SEQ ID NO: 16907 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (4)..(4): base is a locked nucleic acid
  modified_base (8)..(8): base is a locked nucleic acid
  modified_base (10)..(10): base is a locked nucleic acid
cccaaagycarggag

SEQ ID NO: 16908 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (12)..(12): base is a locked nucleic acid
cccaaagycarggag

SEQ ID NO: 16909 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (15)..(15): base is a locked nucleic acid
cccaaagycarggag

SEQ ID NO: 16910 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
cccaaagycarggag

SEQ ID NO: 16911 - DNA, 16 bp, Artificial Sequence
  Oligonucleotide probe
  misc_binding (1)..(16): Hybridization probe for the specific detection of wild-type HIV-1 at codon 148 of the integrase gene.
  modified_base (8)..(8): base is a locked nucleic acid
  modified_base (10)..(10): base is a locked nucleic acid
cccaaagycarggagt

SEQ ID NO: 16912 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (5)..(5): base is a locked nucleic acid
ccaaagycarggagt

SEQ ID NO: 16913 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (3)..(3): base is a locked nucleic acid
ccaaagycarggagt

SEQ ID NO: 16914 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (7)..(7): base is a locked nucleic acid
ccaaagycarggagt

SEQ ID NO: 16915 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
ccaaagycarggagt

SEQ ID NO: 16916 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (15)..(15): base is a locked nucleic acid
ccaaagycarggagt

SEQ ID NO: 16917 - DNA, 16 bp, Artificial Sequence
  Oligonucleotide probe
  misc_binding (1)..(16): Hybridization probe for the specific detection of wild-type HIV-1 at codon 148 of the integrase gene.
ccaaagycarggagta

SEQ ID NO: 16918 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (13)..(13): base is a locked nucleic acid
ccaaagycarggagt

SEQ ID NO: 16919 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (11)..(11): base is a locked nucleic acid
ccaaagycarggagt

SEQ ID NO: 16920 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (7)..(7): base is a locked nucleic acid
  modified_base (8)..(8): base is a locked nucleic acid
  modified_base (10)..(10): base is a locked nucleic acid
ccaaagycarggagt

SEQ ID NO: 16921 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
ccaaagycarggagt

SEQ ID NO: 16922 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (6)..(6): base is a locked nucleic acid
  modified_base (8)..(8): base is a locked nucleic acid
  modified_base (10)..(10): base is a locked nucleic acid
ccaaagycarggagt

SEQ ID NO: 16923 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (1)..(1): base is a locked nucleic acid
  modified_base (8)..(8): base is a locked nucleic acid
  modified_base (10)..(10): base is a locked nucleic acid
ccaaagycarggagt

SEQ ID NO: 16924 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (13)..(13): base is a locked nucleic acid
ccaaagycarggagt

SEQ ID NO: 16925 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (11)..(11): base is a locked nucleic acid
ccaaagycarggagt

SEQ ID NO: 16926 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (15)..(15): base is a locked nucleic acid
ccaaagycarggagt

SEQ ID NO: 16927 - DNA, 15 bp, Artificial Sequence
  Oligonucleotide probe
  misc_binding (1)..(15): Hybridization probe for the specific detection of wild-type HIV-1 at codon 148 of the integrase gene.
  modified_base (8)..(8): base is a locked nucleic acid
  modified_base (10)..(10): base is a locked nucleic acid
ccaaagycarggagt

SEQ ID NO: 16928 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (5)..(5): base is a locked nucleic acid
caaagycarggag

SEQ ID NO: 16929 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (3)..(3): base is a locked nucleic acid
caaagycarggag

SEQ ID NO: 16930 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (1)..(1): base is a locked nucleic acid
caaagycarggag

SEQ ID NO: 16931 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (2)..(2): base is a locked nucleic acid
caaagycarggag

SEQ ID NO: 16932 - DNA, 14 bp, Artificial Sequence
  Oligonucleotide probe
  misc_binding (1)..(14): Hybridization probe for the specific detection of wild-type HIV-1 at codon 148 of the integrase gene.
caaagycarggagt

SEQ ID NO: 16933 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (13)..(13): base is a locked nucleic acid
caaagycarggag

SEQ ID NO: 16934 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (11)..(11): base is a locked nucleic acid
caaagycarggag

SEQ ID NO: 16935 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (7)..(7): base is a locked nucleic acid
  modified_base (8)..(8): base is a locked nucleic acid
  modified_base (10)..(10): base is a locked nucleic acid
caaagycarggag

SEQ ID NO: 16936 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (3)..(3): base is a locked nucleic acid
  modified_base (8)..(8): base is a locked nucleic acid
  modified_base (10)..(10): base is a locked nucleic acid
caaagycarggag

SEQ ID NO: 16937 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
caaagycarggag

SEQ ID NO: 16938 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (4)..(4): base is a locked nucleic acid
  modified_base (8)..(8): base is a locked nucleic acid
  modified_base (10)..(10): base is a locked nucleic acid
caaagycarggag

SEQ ID NO: 16939 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (12)..(12): base is a locked nucleic acid
caaagycarggag

SEQ ID NO: 16940 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (8)..(8): base is a locked nucleic acid
  modified_base (10)..(10): base is a locked nucleic acid
caaagycarggag

SEQ ID NO: 16941 - DNA, 14 bp, Artificial Sequence
  Oligonucleotide probe
  misc_binding (1)..(14): Hybridization probe for the specific detection of wild-type HIV-1 at codon 148 of the integrase gene.
  modified_base (8)..(8): base is a locked nucleic acid
  modified_base (10)..(10): base is a locked nucleic acid
caaagycarggagt

SEQ ID NO: 16942 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (3)..(3): base is a locked nucleic acid
cccaaagycargg

SEQ ID NO: 16943 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (5)..(5): base is a locked nucleic acid
cccaaagycargg

SEQ ID NO: 16944 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (8)..(8): base is a locked nucleic acid
cccaaagycargg

SEQ ID NO: 16945 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (7)..(7): base is a locked nucleic acid
cccaaagycargg

SEQ ID NO: 16946 - DNA, 14 bp, Artificial Sequence
  Oligonucleotide probe
  misc_binding (1)..(14): Hybridization probe for the specific detection of wild-type HIV-1 at codon 148 of the integrase gene.
cccaaagycargga

SEQ ID NO: 16947 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (13)..(13): base is a locked nucleic acid
cccaaagycargg

SEQ ID NO: 16948 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (10)..(10): base is a locked nucleic acid
cccaaagycargg

SEQ ID NO: 16949 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (12)..(12): base is a locked nucleic acid
cccaaagycargg

SEQ ID NO: 16950 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (3)..(3): base is a locked nucleic acid
  modified_base (8)..(8): base is a locked nucleic acid
  modified_base (10)..(10): base is a locked nucleic acid
cccaaagycargg

SEQ ID NO: 16951 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (5)..(5): base is a locked nucleic acid
  modified_base (8)..(8): base is a locked nucleic acid
  modified_base (10)..(10): base is a locked nucleic acid
cccaaagycargg

SEQ ID NO: 16952 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
cccaaagycargg

SEQ ID NO: 16953 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (4)..(4): base is a locked nucleic acid
  modified_base (8)..(8): base is a locked nucleic acid
  modified_base (10)..(10): base is a locked nucleic acid
cccaaagycargg

SEQ ID NO: 16954 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (12)..(12): base is a locked nucleic acid
cccaaagycargg

SEQ ID NO: 16955 - DNA, 14 bp, Artificial Sequence
  Oligonucleotide probe
  misc_binding (1)..(14): Hybridization probe for the specific detection of wild-type HIV-1 at codon 148 of the integrase gene.
  modified_base (8)..(8): base is a locked nucleic acid
  modified_base (10)..(10): base is a locked nucleic acid
cccaaagycargga

SEQ ID NO: 16956 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (5)..(5): base is a locked nucleic acid
ccaaagycargga

SEQ ID NO: 16957 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (3)..(3): base is a locked nucleic acid
ccaaagycargga

SEQ ID NO: 16958 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (7)..(7): base is a locked nucleic acid
ccaaagycargga

SEQ ID NO: 16959 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (8)..(8): base is a locked nucleic acid
ccaaagycargga

SEQ ID NO: 16960 - DNA, 14 bp, Artificial Sequence
  Oligonucleotide probe
  misc_binding (1)..(14): Hybridization probe for the specific detection of wild-type HIV-1 at codon 148 of the integrase gene.
ccaaagycarggag

SEQ ID NO: 16961 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (13)..(13): base is a locked nucleic acid
ccaaagycargga

SEQ ID NO: 16962 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (11)..(11): base is a locked nucleic acid
ccaaagycargga

SEQ ID NO: 16963 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (7)..(7): base is a locked nucleic acid
  modified_base (8)..(8): base is a locked nucleic acid
  modified_base (10)..(10): base is a locked nucleic acid
ccaaagycargga

SEQ ID NO: 16964 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (2)..(2): base is a locked nucleic acid
  modified_base (8)..(8): base is a locked nucleic acid
  modified_base (10)..(10): base is a locked nucleic acid
ccaaagycargga

SEQ ID NO: 16965 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (6)..(6): base is a locked nucleic acid
  modified_base (8)..(8): base is a locked nucleic acid
  modified_base (10)..(10): base is a locked nucleic acid
ccaaagycargga

SEQ ID NO: 16966 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (1)..(1): base is a locked nucleic acid
  modified_base (8)..(8): base is a locked nucleic acid
  modified_base (10)..(10): base is a locked nucleic acid
ccaaagycargga

SEQ ID NO: 16967 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (13)..(13): base is a locked nucleic acid
ccaaagycargga

SEQ ID NO: 16968 - DNA, 13 bp, Artificial Sequence
  Oligonucleotide probe
  misc_binding (1)..(13): Hybridization probe for the specific detection of wild-type HIV-1 at codon 148 of the integrase gene.
  modified_base (8)..(8): base is a locked nucleic acid
  modified_base (10)..(10): base is a locked nucleic acid
  modified_base (11)..(11): base is a locked nucleic acid
ccaaagycargga

SEQ ID NO: 16969 - DNA, 14 bp, Artificial Sequence
  Oligonucleotide probe
  misc_binding (1)..(14): Hybridization probe for the specific detection of wild-type HIV-1 at codon 148 of the integrase gene.
  modified_base (8)..(8): base is a locked nucleic acid
  modified_base (10)..(10): base is a locked nucleic acid
ccaaagycarggag

SEQ ID NO: 16970 - DNA, 19 bp, Artificial Sequence
  Oligonucleotide probe
  misc_binding (1)..(19): Hybridization probe for the specific detection of wild-type HIV-1 at codon 148 of the integrase gene.
ccaaagycarggagtagtr

SEQ ID NO: 16971 - DNA, 19 bp, Artificial Sequence
  Oligonucleotide probe
  misc_binding (1)..(19): Hybridization probe for the specific detection of wild-type HIV-1 at codon 148 of the integrase gene.
ccccaaagycarggagtag

SEQ ID NO: 16972 - DNA, 19 bp, Artificial Sequence
  Oligonucleotide probe
  misc_binding (1)..(19): Hybridization probe for the specific detection of wild-type HIV-1 at codon 148 of the integrase gene.
cccaaagycarggagtagt

SEQ ID NO: 16973 - DNA, 17 bp, Artificial Sequence
  Oligonucleotide probe
  misc_binding (1)..(17): Hybridization probe for the specific detection of wild-type HIV-1 at codon 148 of the integrase gene.
caaagycarggagtagt

SEQ ID NO: 16974 - DNA, 17 bp, Artificial Sequence
  Oligonucleotide probe
  misc_binding (1)..(17): Hybridization probe for the specific detection of wild-type HIV-1 at codon 148 of the integrase gene.
cccaaagycarggagta

SEQ ID NO: 16975 - DNA, 17 bp, Artificial Sequence
  Oligonucleotide probe
  misc_binding (1)..(17): Hybridization probe for the specific detection of wild-type HIV-1 at codon 148 of the integrase gene.
ccaaagycarggagtag

SEQ ID NO: 16976 - DNA, 15 bp, Artificial Sequence
  Oligonucleotide probe
  misc_binding (1)..(15): Hybridization probe for the specific detection of wild-type HIV-1 at codon 148 of the integrase gene.
caaagycarggagta

SEQ ID NO: 16977 - DNA, 16 bp, Artificial Sequence
  Oligonucleotide probe
  misc_binding (1)..(16): Hybridization probe for the specific detection of wild-type HIV-1 at codon 148 of the integrase gene.
caaagycarggagtag

SEQ ID NO: 16978 - DNA, 15 bp, Artificial Sequence
  Oligonucleotide probe
  misc_binding (1)..(15): Hybridization probe for the specific detection of wild-type HIV-1 at codon 148 of the integrase gene.
cccaaagycarggag

SEQ ID NO: 16979 - DNA, 16 bp, Artificial Sequence
  Oligonucleotide probe
  misc_binding (1)..(16): Hybridization probe for the specific detection of wild-type HIV-1 at codon 148 of the integrase gene.
cccaaagycarggagt

SEQ ID NO: 16980 - DNA, 15 bp, Artificial Sequence
  Oligonucleotide probe
  misc_binding (1)..(15): Hybridization probe for the specific detection of wild-type HIV-1 at codon 148 of the integrase gene.
ccaaagycarggagt

SEQ ID NO: 16981 - DNA, 13 bp, Artificial Sequence
  Oligonucleotide probe
  misc_binding (1)..(13): Hybridization probe for the specific detection of wild-type HIV-1 at codon 148 of the integrase gene.
caaagycarggag

SEQ ID NO: 16982 - DNA, 13 bp, Artificial Sequence
  Oligonucleotide probe
  misc_binding (1)..(13): Hybridization probe for the specific detection of wild-type HIV-1 at codon 148 of the integrase gene.
cccaaagycargg

SEQ ID NO: 16983 - DNA, 13 bp, Artificial Sequence
  Oligonucleotide probe
  misc_binding (1)..(13): Hybridization probe for the specific detection of wild-type HIV-1 at codon 148 of the integrase gene.
ccaaagycargga

SEQ ID NO: 16984 - DNA, 15 bp, Artificial Sequence
  Oligonucleotide probe
  misc_binding (1)..(15): Hybridization probe for the specific detection of wild-type HIV-1 at codon 148 of the integrase gene.
caaagtcarggagta

SEQ ID NO: 16985 - DNA, 15 bp, Artificial Sequence
  Oligonucleotide probe
  misc_binding (1)..(15): Hybridization probe for the specific detection of wild-type HIV-1 at codon 153 of the integrase gene.
attcatrctttctac

SEQ ID NO: 16986 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
gartcyatgaataargaat

SEQ ID NO: 16987 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (2)..(2): base is a locked nucleic acid
gartcyatgaataargaat

SEQ ID NO: 16988 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (7)..(7): base is a locked nucleic acid
gartcyatgaataargaat

SEQ ID NO: 16989 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (5)..(5): base is a locked nucleic acid
gartcyatgaataargaat

SEQ ID NO: 16990 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (16)..(16): base is a locked nucleic acid
gartcyatgaataargaat

SEQ ID NO: 16991 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (18)..(18): base is a locked nucleic acid
gartcyatgaataargaat

SEQ ID NO: 16992 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (15)..(15): base is a locked nucleic acid
gartcyatgaataargaat

SEQ ID NO: 16993 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (12)..(12): base is a locked nucleic acid
gartcyatgaataargaat

SEQ ID NO: 16994 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
gartcyatgaataargaat

SEQ ID NO: 16995 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (2)..(2): base is a locked nucleic acid
  modified_base (9)..(9): base is a locked nucleic acid
  modified_base (11)..(11): base is a locked nucleic acid
gartcyatgaataargaat

SEQ ID NO: 16996 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (4)..(4): base is a locked nucleic acid
  modified_base (9)..(9): base is a locked nucleic acid
  modified_base (11)..(11): base is a locked nucleic acid
gartcyatgaataargaat

SEQ ID NO: 16997 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (5)..(5): base is a locked nucleic acid
  modified_base (9)..(9): base is a locked nucleic acid
  modified_base (11)..(11): base is a locked nucleic acid
gartcyatgaataargaat

SEQ ID NO: 16998 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (13)..(13): base is a locked nucleic acid
gartcyatgaataargaat

SEQ ID NO: 16999 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (14)..(14): base is a locked nucleic acid
gartcyatgaataargaat

SEQ ID NO: 17000 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (18)..(18): base is a locked nucleic acid
gartcyatgaataargaat

SEQ ID NO: 17001 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (17)..(17): base is a locked nucleic acid
gartcyatgaataargaat

SEQ ID NO: 17002 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (4)..(4): base is a locked nucleic acid
artcyatgaataargaatt

SEQ ID NO: 17003 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (6)..(6): base is a locked nucleic acid
artcyatgaataargaatt

SEQ ID NO: 17004 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (3)..(3): base is a locked nucleic acid
artcyatgaataargaatt

SEQ ID NO: 17005 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (2)..(2): base is a locked nucleic acid
artcyatgaataargaatt

SEQ ID NO: 17006 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (19)..(19): base is a locked nucleic acid
artcyatgaataargaatt

SEQ ID NO: 17007 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (11)..(11): base is a locked nucleic acid
artcyatgaataargaatt

SEQ ID NO: 17008 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (15)..(15): base is a locked nucleic acid
artcyatgaataargaatt

SEQ ID NO: 17009 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (16)..(16): base is a locked nucleic acid
artcyatgaataargaatt

SEQ ID NO: 17010 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (3)..(3): base is a locked nucleic acid
  modified_base (9)..(9): base is a locked nucleic acid
  modified_base (11)..(11): base is a locked nucleic acid
artcyatgaataargaatt

SEQ ID NO: 17011 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (7)..(7): base is a locked nucleic acid
  modified_base (9)..(9): base is a locked nucleic acid
  modified_base (11)..(11): base is a locked nucleic acid
artcyatgaataargaatt

SEQ ID NO: 17012 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (6)..(6): base is a locked nucleic acid
  modified_base (9)..(9): base is a locked nucleic acid
  modified_base (11)..(11): base is a locked nucleic acid
artcyatgaataargaatt

SEQ ID NO: 17013 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
artcyatgaataargaatt

SEQ ID NO: 17014 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (15)..(15): base is a locked nucleic acid
artcyatgaataargaatt

SEQ ID NO: 17015 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (17)..(17): base is a locked nucleic acid
artcyatgaataargaatt

SEQ ID NO: 17016 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (18)..(18): base is a locked nucleic acid
artcyatgaataargaatt

SEQ ID NO: 17017 - DNA, 19 bp, Artificial Sequence
  Oligonucleotide probe
  misc_binding (1)..(19): Hybridization probe for the specific detection of wild-type HIV-1 at codon 155 of the integrase gene.
  modified_base (9)..(9): base is a locked nucleic acid
  modified_base (11)..(11): base is a locked nucleic acid
  modified_base (13)..(13): base is a locked nucleic acid
artcyatgaataargaatt

SEQ ID NO: 17018 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
artcyatgaataargaa

SEQ ID NO: 17019 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (1)..(1): base is a locked nucleic acid
artcyatgaataargaa

SEQ ID NO: 17020 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (6)..(6): base is a locked nucleic acid
artcyatgaataargaa

SEQ ID NO: 17021 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (4)..(4): base is a locked nucleic acid
artcyatgaataargaa

SEQ ID NO: 17022 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (15)..(15): base is a locked nucleic acid
artcyatgaataargaa

SEQ ID NO: 17023 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (17)..(17): base is a locked nucleic acid
artcyatgaataargaa

SEQ ID NO: 17024 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (14)..(14): base is a locked nucleic acid
artcyatgaataargaa

SEQ ID NO: 17025 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (11)..(11): base is a locked nucleic acid
artcyatgaataargaa

SEQ ID NO: 17026 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (7)..(7): base is a locked nucleic acid
  modified_base (8)..(8): base is a locked nucleic acid
  modified_base (10)..(10): base is a locked nucleic acid
artcyatgaataargaa

SEQ ID NO: 17027 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (1)..(1): base is a locked nucleic acid
  modified_base (8)..(8): base is a locked nucleic acid
  modified_base (10)..(10): base is a locked nucleic acid
artcyatgaataargaa

SEQ ID NO: 17028 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (3)..(3): base is a locked nucleic acid
  modified_base (8)..(8): base is a locked nucleic acid
  modified_base (10)..(10): base is a locked nucleic acid
artcyatgaataargaa

SEQ ID NO: 17029 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (4)..(4): base is a locked nucleic acid
  modified_base (8)..(8): base is a locked nucleic acid
  modified_base (10)..(10): base is a locked nucleic acid
artcyatgaataargaa

SEQ ID NO: 17030 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (12)..(12): base is a locked nucleic acid
artcyatgaataargaa

SEQ ID NO: 17031 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (13)..(13): base is a locked nucleic acid
artcyatgaataargaa

SEQ ID NO: 17032 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (17)..(17): base is a locked nucleic acid
artcyatgaataargaa

SEQ ID NO: 17033 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (16)..(16): base is a locked nucleic acid
artcyatgaataargaa

SEQ ID NO: 17034 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (3)..(3): base is a locked nucleic acid
rtcyatgaataargaat

SEQ ID NO: 17035 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (5)..(5): base is a locked nucleic acid
rtcyatgaataargaat

SEQ ID NO: 17036 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (2)..(2): base is a locked nucleic acid
rtcyatgaataargaat

SEQ ID NO: 17037 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (1)..(1): base is a locked nucleic acid
rtcyatgaataargaat

SEQ ID NO: 17038 - DNA, 17 bp, Artificial Sequence
  Oligonucleotide probe
  misc_binding (1)..(17): Hybridization probe for the specific detection of wild-type HIV-1 at codon 155 of the integrase gene.
rtcyatgaataargaat

SEQ ID NO: 17039 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (10)..(10): base is a locked nucleic acid
rtcyatgaataargaat

SEQ ID NO: 17040 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (14)..(14): base is a locked nucleic acid
rtcyatgaataargaat

SEQ ID NO: 17041 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (15)..(15): base is a locked nucleic acid
rtcyatgaataargaat

SEQ ID NO: 17042 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (2)..(2): base is a locked nucleic acid
  modified_base (8)..(8): base is a locked nucleic acid
  modified_base (10)..(10): base is a locked nucleic acid
rtcyatgaataargaat

SEQ ID NO: 17043 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (6)..(6): base is a locked nucleic acid
  modified_base (8)..(8): base is a locked nucleic acid
  modified_base (10)..(10): base is a locked nucleic acid
rtcyatgaataargaat

SEQ ID NO: 17044 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (5)..(5): base is a locked nucleic acid
  modified_base (8)..(8): base is a locked nucleic acid
  modified_base (10)..(10): base is a locked nucleic acid
rtcyatgaataargaat

SEQ ID NO: 17045 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (7)..(7): base is a locked nucleic acid
  modified_base (8)..(8): base is a locked nucleic acid
  modified_base (10)..(10): base is a locked nucleic acid
rtcyatgaataargaat

SEQ ID NO: 17046 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (14)..(14): base is a locked nucleic acid
rtcyatgaataargaat

SEQ ID NO: 17047 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (16)..(16): base is a locked nucleic acid
rtcyatgaataargaat

SEQ ID NO: 17048 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (17)..(17): base is a locked nucleic acid
rtcyatgaataargaat

SEQ ID NO: 17049 - DNA, 17 bp, Artificial Sequence
  Oligonucleotide probe
  misc_binding (1)..(17): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (12)..(12): base is a locked nucleic acid
rtcyatgaataargaat

SEQ ID NO: 17050 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (8)..(8): base is a locked nucleic acid
artcyatgaataarg

SEQ ID NO: 17051 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (1)..(1): base is a locked nucleic acid
artcyatgaataarg

SEQ ID NO: 17052 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (6)..(6): base is a locked nucleic acid
artcyatgaataarg

SEQ ID NO: 17053 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (4)..(4): base is a locked nucleic acid
artcyatgaataarg

SEQ ID NO: 17054 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (15)..(15): base is a locked nucleic acid
artcyatgaataarg

SEQ ID NO: 17055 - DNA, 16 bp, Artificial Sequence
  Oligonucleotide probe
  misc_binding (1)..(16): Hybridization probe for the specific detection of wild-type HIV-1 at codon 155 of the integrase gene.
artcyatgaataarga

SEQ ID NO: 17056 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (14)..(14): base is a locked nucleic acid
artcyatgaataarg

SEQ ID NO: 17057 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (11)..(11): base is a locked nucleic acid
artcyatgaataarg

SEQ ID NO: 17058 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (7)..(7): base is a locked nucleic acid
  modified_base (8)..(8): base is a locked nucleic acid
  modified_base (10)..(10): base is a locked nucleic acid
artcyatgaataarg

SEQ ID NO: 17059 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (1)..(1): base is a locked nucleic acid
  modified_base (8)..(8): base is a locked nucleic acid
  modified_base (10)..(10): base is a locked nucleic acid
artcyatgaataarg

SEQ ID NO: 17060 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (3)..(3): base is a locked nucleic acid
  modified_base (8)..(8): base is a locked nucleic acid
  modified_base (10)..(10): base is a locked nucleic acid
artcyatgaataarg

SEQ ID NO: 17061 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (4)..(4): base is a locked nucleic acid
  modified_base (8)..(8): base is a locked nucleic acid
  modified_base (10)..(10): base is a locked nucleic acid
artcyatgaataarg

SEQ ID NO: 17062 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (12)..(12): base is a locked nucleic acid
artcyatgaataarg

SEQ ID NO: 17063 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (13)..(13): base is a locked nucleic acid
artcyatgaataarg

SEQ ID NO: 17064 - DNA, 16 bp, Artificial Sequence
  Oligonucleotide probe
  misc_binding (1)..(16): Hybridization probe for the specific detection of wild-type HIV-1 at codon 155 of the integrase gene.
  modified_base (8)..(8): base is a locked nucleic acid
  modified_base (10)..(10): base is a locked nucleic acid
artcyatgaataarga

SEQ ID NO: 17065 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (8)..(8): base is a locked nucleic acid
  modified_base (10)..(10): base is a locked nucleic acid
artcyatgaataarg

SEQ ID NO: 17066 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (3)..(3): base is a locked nucleic acid
rtcyatgaataarga

SEQ ID NO: 17067 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (5)..(5): base is a locked nucleic acid
rtcyatgaataarga

SEQ ID NO: 17068 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (2)..(2): base is a locked nucleic acid
rtcyatgaataarga

SEQ ID NO: 17069 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (1)..(1): base is a locked nucleic acid
rtcyatgaataarga

SEQ ID NO: 17070 - DNA, 16 bp, Artificial Sequence
  Oligonucleotide probe
  misc_binding (1)..(16): Hybridization probe for the specific detection of wild-type HIV-1 at codon 155 of the integrase gene.
rtcyatgaataargaa

SEQ ID NO: 17071 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (10)..(10): base is a locked nucleic acid
rtcyatgaataarga

SEQ ID NO: 17072 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (14)..(14): base is a locked nucleic acid
rtcyatgaataarga

SEQ ID NO: 17073 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (15)..(15): base is a locked nucleic acid
rtcyatgaataarga

SEQ ID NO: 17074 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (2)..(2): base is a locked nucleic acid
  modified_base (8)..(8): base is a locked nucleic acid
  modified_base (10)..(10): base is a locked nucleic acid
rtcyatgaataarga

SEQ ID NO: 17075 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (6)..(6): base is a locked nucleic acid
  modified_base (8)..(8): base is a locked nucleic acid
  modified_base (10)..(10): base is a locked nucleic acid
rtcyatgaataarga

SEQ ID NO: 17076 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (5)..(5): base is a locked nucleic acid
  modified_base (8)..(8): base is a locked nucleic acid
  modified_base (10)..(10): base is a locked nucleic acid
rtcyatgaataarga

SEQ ID NO: 17077 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (7)..(7): base is a locked nucleic acid
  modified_base (8)..(8): base is a locked nucleic acid
  modified_base (10)..(10): base is a locked nucleic acid
rtcyatgaataarga

SEQ ID NO: 17078 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (14)..(14): base is a locked nucleic acid
rtcyatgaataarga

SEQ ID NO: 17079 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (8)..(8): base is a locked nucleic acid
  modified_base (10)..(10): base is a locked nucleic acid
rtcyatgaataarga

SEQ ID NO: 17080 - DNA, 16 bp, Artificial Sequence
  Oligonucleotide probe
  misc_binding (1)..(16): Hybridization probe for the specific detection of wild-type HIV-1 at codon 155 of the integrase gene.
  modified_base (8)..(8): base is a locked nucleic acid
  modified_base (10)..(10): base is a locked nucleic acid
rtcyatgaataargaa

SEQ ID NO: 17081 - DNA, 15 bp, Artificial Sequence
  Oligonucleotide probe
  misc_binding (1)..(15): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (12)..(12): base is a locked nucleic acid
rtcyatgaataarga

SEQ ID NO: 17082 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (8)..(8): base is a locked nucleic acid
artcyatgaataa

SEQ ID NO: 17083 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (1)..(1): base is a locked nucleic acid
artcyatgaataa

SEQ ID NO: 17084 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (6)..(6): base is a locked nucleic acid
artcyatgaataa

SEQ ID NO: 17085 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (4)..(4): base is a locked nucleic acid
artcyatgaataa

SEQ ID NO: 17086 - DNA, 14 bp, Artificial Sequence
  Oligonucleotide probe
  misc_binding (1)..(14): Hybridization probe for the specific detection of wild-type HIV-1 at codon 155 of the integrase gene.
artcyatgaataar

SEQ ID NO: 17087 - DNA, 13 bp, Artificial Sequence
  Oligonucleotide probe
  misc_binding (1)..(13): Hybridization probe for the specific detection of wild-type HIV-1 at codon 155 of the integrase gene.
artcyatgaataa

SEQ ID NO: 17088 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (11)..(11): base is a locked nucleic acid
artcyatgaataa

SEQ ID NO: 17089 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (7)..(7): base is a locked nucleic acid
  modified_base (8)..(8): base is a locked nucleic acid
  modified_base (10)..(10): base is a locked nucleic acid
artcyatgaataa

SEQ ID NO: 17090 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (1)..(1): base is a locked nucleic acid
  modified_base (8)..(8): base is a locked nucleic acid
  modified_base (10)..(10): base is a locked nucleic acid
artcyatgaataa

SEQ ID NO: 17091 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (3)..(3): base is a locked nucleic acid
  modified_base (8)..(8): base is a locked nucleic acid
  modified_base (10)..(10): base is a locked nucleic acid
artcyatgaataa

SEQ ID NO: 17092 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (4)..(4): base is a locked nucleic acid
  modified_base (8)..(8): base is a locked nucleic acid
  modified_base (10)..(10): base is a locked nucleic acid
artcyatgaataa

SEQ ID NO: 17093 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (12)..(12): base is a locked nucleic acid
artcyatgaataa

SEQ ID NO: 17094 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (13)..(13): base is a locked nucleic acid
artcyatgaataa

SEQ ID NO: 17095 - DNA, 14 bp, Artificial Sequence
  Oligonucleotide probe
  misc_binding (1)..(14): Hybridization probe for the specific detection of wild-type HIV-1 at codon 155 of the integrase gene.
  modified_base (8)..(8): base is a locked nucleic acid
  modified_base (10)..(10): base is a locked nucleic acid
artcyatgaataar

SEQ ID NO: 17096 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (3)..(3): base is a locked nucleic acid
rtcyatgaataar

SEQ ID NO: 17097 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (5)..(5): base is a locked nucleic acid
rtcyatgaataar

SEQ ID NO: 17098 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (2)..(2): base is a locked nucleic acid
rtcyatgaataar

SEQ ID NO: 17099 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (1)..(1): base is a locked nucleic acid
rtcyatgaataar

SEQ ID NO: 17100 - DNA, 14 bp, Artificial Sequence
  Oligonucleotide probe
  misc_binding (1)..(14): Hybridization probe for the specific detection of wild-type HIV-1 at codon 155 of the integrase gene.
rtcyatgaataarg

SEQ ID NO: 17101 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (10)..(10): base is a locked nucleic acid
rtcyatgaataar

SEQ ID NO: 17102 - DNA, 13 bp, Artificial Sequence
  Oligonucleotide probe
  misc_binding (1)..(13): Hybridization probe for the specific detection of wild-type HIV-1 at codon 155 of the integrase gene.
rtcyatgaataar

SEQ ID NO: 17103 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (2)..(2): base is a locked nucleic acid
  modified_base (8)..(8): base is a locked nucleic acid
  modified_base (10)..(10): base is a locked nucleic acid
rtcyatgaataar

SEQ ID NO: 17104 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (6)..(6): base is a locked nucleic acid
  modified_base (8)..(8): base is a locked nucleic acid
  modified_base (10)..(10): base is a locked nucleic acid
rtcyatgaataar

SEQ ID NO: 17105 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (5)..(5): base is a locked nucleic acid
  modified_base (8)..(8): base is a locked nucleic acid
  modified_base (10)..(10): base is a locked nucleic acid
rtcyatgaataar

SEQ ID NO: 17106 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (7)..(7): base is a locked nucleic acid
  modified_base (8)..(8): base is a locked nucleic acid
  modified_base (10)..(10): base is a locked nucleic acid
rtcyatgaataar

SEQ ID NO: 17107 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (8)..(8): base is a locked nucleic acid
  modified_base (10)..(10): base is a locked nucleic acid
rtcyatgaataar

SEQ ID NO: 17108 - DNA, 14 bp, Artificial Sequence
  Oligonucleotide probe
  misc_binding (1)..(14): Hybridization probe for the specific detection of wild-type HIV-1 at codon 155 of the integrase gene.
  modified_base (8)..(8): base is a locked nucleic acid
  modified_base (10)..(10): base is a locked nucleic acid
rtcyatgaataarg

SEQ ID NO: 17109 - DNA, 13 bp, Artificial Sequence
  Oligonucleotide probe
  misc_binding (1)..(13): Hybridization probe for the specific detection of wild-type HIV-1 at codon 155 of the integrase gene.
  modified_base (8)..(8): base is a locked nucleic acid
  modified_base (10)..(10): base is a locked nucleic acid
  modified_base (12)..(12): base is a locked nucleic acid
rtcyatgaataar

SEQ ID NO: 17110 - DNA, 19 bp, Artificial Sequence
  Oligonucleotide probe
  misc_binding (1)..(19): Hybridization probe for the specific detection of wild-type HIV-1 at codon 155 of the integrase gene.
gartcyatgaataargaat

SEQ ID NO: 17111 - DNA, 19 bp, Artificial Sequence
  Oligonucleotide probe
  misc_binding (1)..(19): Hybridization probe for the specific detection of wild-type HIV-1 at codon 155 of the integrase gene.
artcyatgaataargaatt

SEQ ID NO: 17112 - DNA, 17 bp, Artificial Sequence
  Oligonucleotide probe
  misc_binding (1)..(17): Hybridization probe for the specific detection of wild-type HIV-1 at codon 155 of the integrase gene.
artcyatgaataargaa

SEQ ID NO: 17113 - DNA, 17 bp, Artificial Sequence
  Oligonucleotide probe
  misc_binding (1)..(17): Hybridization probe for the specific detection of wild-type HIV-1 at codon 155 of the integrase gene.
rtcyatgaataargaat

SEQ ID NO: 17114 - DNA, 15 bp, Artificial Sequence
  Oligonucleotide probe
  misc_binding (1)..(15): Hybridization probe for the specific detection of wild-type HIV-1 at codon 155 of the integrase gene.
artcyatgaataarg

SEQ ID NO: 17115 - DNA, 15 bp, Artificial Sequence
  Oligonucleotide probe
  misc_binding (1)..(15): Hybridization probe for the specific detection of wild-type HIV-1 at codon 155 of the integrase gene.
rtcyatgaataarga

SEQ ID NO: 17116 - DNA, 13 bp, Artificial Sequence
  Oligonucleotide probe
  misc_binding (1)..(13): Hybridization probe for the specific detection of wild-type HIV-1 at codon 155 of the integrase gene.
artcyatgaataa

SEQ ID NO: 17117 - DNA, 13 bp, Artificial Sequence
  Oligonucleotide probe
  misc_binding (1)..(13): Hybridization probe for the specific detection of wild-type HIV-1 at codon 155 of the integrase gene.
rtcyatgaataar

SEQ ID NO: 17118 - DNA, 15 bp, Artificial Sequence
  Oligonucleotide probe
  misc_binding (1)..(15): Hybridization probe for the specific detection of wild-type HIV-1 at codon 155 of the integrase gene.
tctatgaayaaagaa

SEQ ID NO: 17119 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (3)..(3): base is a locked nucleic acid
aaaatyataggrcargtma

SEQ ID NO: 17120 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (4)..(4): base is a locked nucleic acid
aaaatyataggrcargtma

SEQ ID NO: 17121 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (8)..(8): base is a locked nucleic acid
aaaatyataggrcargtma

SEQ ID NO: 17122 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (2)..(2): base is a locked nucleic acid
aaaatyataggrcargtma

SEQ ID NO: 17123 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (16)..(16): base is a locked nucleic acid
aaaatyataggrcargtma

SEQ ID NO: 17124 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (11)..(11): base is a locked nucleic acid
aaaatyataggrcargtma

SEQ ID NO: 17125 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (12)..(12): base is a locked nucleic acid
aaaatyataggrcargtma

SEQ ID NO: 17126 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (15)..(15): base is a locked nucleic acid
aaaatyataggrcargtma

SEQ ID NO: 17127 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (5)..(5): base is a locked nucleic acid
  modified_base (9)..(9): base is a locked nucleic acid
  modified_base (11)..(11): base is a locked nucleic acid
aaaatyataggrcargtma

SEQ ID NO: 17128 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (3)..(3): base is a locked nucleic acid
  modified_base (9)..(9): base is a locked nucleic acid
  modified_base (11)..(11): base is a locked nucleic acid
aaaatyataggrcargtma

SEQ ID NO: 17129 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (6)..(6): base is a locked nucleic acid
  modified_base (9)..(9): base is a locked nucleic acid
  modified_base (11)..(11): base is a locked nucleic acid
aaaatyataggrcargtma

SEQ ID NO: 17130 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (7)..(7): base is a locked nucleic acid
  modified_base (9)..(9): base is a locked nucleic acid
  modified_base (11)..(11): base is a locked nucleic acid
aaaatyataggrcargtma

SEQ ID NO: 17131 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (9)..(9): base is a locked nucleic acid
  modified_base (11)..(11): base is a locked nucleic acid
  modified_base (12)..(12): base is a locked nucleic acid
aaaatyataggrcargtma

SEQ ID NO: 17132 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (9)..(9): base is a locked nucleic acid
  modified_base (11)..(11): base is a locked nucleic acid
  modified_base (14)..(14): base is a locked nucleic acid
aaaatyataggrcargtma

SEQ ID NO: 17133 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (9)..(9): base is a locked nucleic acid
  modified_base (11)..(11): base is a locked nucleic acid
  modified_base (13)..(13): base is a locked nucleic acid
aaaatyataggrcargtma

SEQ ID NO: 17134 - DNA, 19 bp, Artificial Sequence
  Oligonucleotide probe
  misc_binding (1)..(19): Hybridization probe for the specific detection of wild-type HIV-1 at codon 163 of the integrase gene.
  modified_base (9)..(9): base is a locked nucleic acid
  modified_base (11)..(11): base is a locked nucleic acid
  modified_base (15)..(15): base is a locked nucleic acid
aaaatyataggrcargtma

SEQ ID NO: 17135 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (2)..(2): base is a locked nucleic acid
aaatyataggrcargtm

SEQ ID NO: 17136 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (3)..(3): base is a locked nucleic acid
aaatyataggrcargtm

SEQ ID NO: 17137 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (7)..(7): base is a locked nucleic acid
aaatyataggrcargtm

SEQ ID NO: 17138 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (1)..(1): base is a locked nucleic acid
aaatyataggrcargtm

SEQ ID NO: 17139 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (15)..(15): base is a locked nucleic acid
aaatyataggrcargtm

SEQ ID NO: 17140 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (10)..(10): base is a locked nucleic acid
aaatyataggrcargtm

SEQ ID NO: 17141 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (11)..(11): base is a locked nucleic acid
aaatyataggrcargtm

SEQ ID NO: 17142 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (14)..(14): base is a locked nucleic acid
aaatyataggrcargtm

SEQ ID NO: 17143 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (4)..(4): base is a locked nucleic acid
  modified_base (8)..(8): base is a locked nucleic acid
  modified_base (10)..(10): base is a locked nucleic acid
aaatyataggrcargtm

SEQ ID NO: 17144 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (2)..(2): base is a locked nucleic acid
  modified_base (8)..(8): base is a locked nucleic acid
  modified_base (10)..(10): base is a locked nucleic acid
aaatyataggrcargtm

SEQ ID NO: 17145 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (5)..(5): base is a locked nucleic acid
  modified_base (8)..(8): base is a locked nucleic acid
  modified_base (10)..(10): base is a locked nucleic acid
aaatyataggrcargtm

SEQ ID NO: 17146 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (6)..(6): base is a locked nucleic acid
  modified_base (8)..(8): base is a locked nucleic acid
  modified_base (10)..(10): base is a locked nucleic acid
aaatyataggrcargtm

SEQ ID NO: 17147 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (11)..(11): base is a locked nucleic acid
aaatyataggrcargtm

SEQ ID NO: 17148 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (13)..(13): base is a locked nucleic acid
aaatyataggrcargtm

SEQ ID NO: 17149 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (12)..(12): base is a locked nucleic acid
aaatyataggrcargtm

SEQ ID NO: 17150 - DNA, 17 bp, Artificial Sequence
  Oligonucleotide probe
  misc_binding (1)..(17): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (14)..(14): base is a locked nucleic acid
aaatyataggrcargtm

SEQ ID NO: 17151 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (2)..(2): base is a locked nucleic acid
aaatyataggrcarg

SEQ ID NO: 17152 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (3)..(3): base is a locked nucleic acid
aaatyataggrcarg

SEQ ID NO: 17153 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (7)..(7): base is a locked nucleic acid
aaatyataggrcarg

SEQ ID NO: 17154 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (1)..(1): base is a locked nucleic acid
aaatyataggrcarg

SEQ ID NO: 17155 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (15)..(15): base is a locked nucleic acid
aaatyataggrcarg

SEQ ID NO: 17156 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (10)..(10): base is a locked nucleic acid
aaatyataggrcarg

SEQ ID NO: 17157 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (11)..(11): base is a locked nucleic acid
aaatyataggrcarg

SEQ ID NO: 17158 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (14)..(14): base is a locked nucleic acid
aaatyataggrcarg

SEQ ID NO: 17159 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (4)..(4): base is a locked nucleic acid
  modified_base (8)..(8): base is a locked nucleic acid
  modified_base (10)..(10): base is a locked nucleic acid
aaatyataggrcarg

SEQ ID NO: 17160 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (2)..(2): base is a locked nucleic acid
  modified_base (8)..(8): base is a locked nucleic acid
  modified_base (10)..(10): base is a locked nucleic acid
aaatyataggrcarg

SEQ ID NO: 17161 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (5)..(5): base is a locked nucleic acid
  modified_base (8)..(8): base is a locked nucleic acid
  modified_base (10)..(10): base is a locked nucleic acid
aaatyataggrcarg

SEQ ID NO: 17162 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (6)..(6): base is a locked nucleic acid
  modified_base (8)..(8): base is a locked nucleic acid
  modified_base (10)..(10): base is a locked nucleic acid
aaatyataggrcarg

SEQ ID NO: 17163 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (11)..(11): base is a locked nucleic acid
aaatyataggrcarg

SEQ ID NO: 17164 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (13)..(13): base is a locked nucleic acid
aaatyataggrcarg

SEQ ID NO: 17165 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (12)..(12): base is a locked nucleic acid
aaatyataggrcarg

SEQ ID NO: 17166 - DNA, 15 bp, Artificial Sequence
  Oligonucleotide probe
  misc_binding (1)..(15): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (14)..(14): base is a locked nucleic acid
aaatyataggrcarg

SEQ ID NO: 17167 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (2)..(2): base is a locked nucleic acid
aaatyataggrca

SEQ ID NO: 17168 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (3)..(3): base is a locked nucleic acid
aaatyataggrca

SEQ ID NO: 17169 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (7)..(7): base is a locked nucleic acid
aaatyataggrca

SEQ ID NO: 17170 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (1)..(1): base is a locked nucleic acid
aaatyataggrca

SEQ ID NO: 17171 - DNA, 14 bp, Artificial Sequence
  Oligonucleotide probe
  misc_binding (1)..(14): Hybridization probe for the specific detection of wild-type HIV-1 at codon 163 of the integrase gene.
aaatyataggrcar

SEQ ID NO: 17172 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (10)..(10): base is a locked nucleic acid
aaatyataggrca

SEQ ID NO: 17173 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (11)..(11): base is a locked nucleic acid
aaatyataggrca

SEQ ID NO: 17174 - DNA, 13 bp, Artificial Sequence
  Oligonucleotide probe
  misc_binding (1)..(13): Hybridization probe for the specific detection of wild-type HIV-1 at codon 163 of the integrase gene.
aaatyataggrca

SEQ ID NO: 17175 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (4)..(4): base is a locked nucleic acid
  modified_base (8)..(8): base is a locked nucleic acid
  modified_base (10)..(10): base is a locked nucleic acid
aaatyataggrca

SEQ ID NO: 17176 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (2)..(2): base is a locked nucleic acid
  modified_base (8)..(8): base is a locked nucleic acid
  modified_base (10)..(10): base is a locked nucleic acid
aaatyataggrca

SEQ ID NO: 17177 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (5)..(5): base is a locked nucleic acid
  modified_base (8)..(8): base is a locked nucleic acid
  modified_base (10)..(10): base is a locked nucleic acid
aaatyataggrca

SEQ ID NO: 17178 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (6)..(6): base is a locked nucleic acid
  modified_base (8)..(8): base is a locked nucleic acid
  modified_base (10)..(10): base is a locked nucleic acid
aaatyataggrca

SEQ ID NO: 17179 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (11)..(11): base is a locked nucleic acid
aaatyataggrca

SEQ ID NO: 17180 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (13)..(13): base is a locked nucleic acid
aaatyataggrca

SEQ ID NO: 17181 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (8)..(8): base is a locked nucleic acid
  modified_base (10)..(10): base is a locked nucleic acid
  modified_base (12)..(12): base is a locked nucleic acid
aaatyataggrca

SEQ ID NO: 17182 - DNA, 13 bp, Artificial Sequence
  Oligonucleotide probe
  misc_binding (1)..(13): Hybridization probe for the specific detection of wild-type HIV-1 at codon 163 of the integrase gene.
  modified_base (8)..(8): base is a locked nucleic acid
  modified_base (10)..(10): base is a locked nucleic acid
aaatyataggrca

SEQ ID NO: 17183 - DNA, 19 bp, Artificial Sequence
  Oligonucleotide probe
  misc_binding (1)..(19): Hybridization probe for the specific detection of wild-type HIV-1 at codon 163 of the integrase gene.
aaaatyataggrcargtma

SEQ ID NO: 17184 - DNA, 17 bp, Artificial Sequence
  Oligonucleotide probe
  misc_binding (1)..(17): Hybridization probe for the specific detection of wild-type HIV-1 at codon 163 of the integrase gene.
aaatyataggrcargtm

SEQ ID NO: 17185 - DNA, 15 bp, Artificial Sequence
  Oligonucleotide probe
  misc_binding (1)..(15): Hybridization probe for the specific detection of wild-type HIV-1 at codon 163 of the integrase gene.
aaatyataggrcarg

SEQ ID NO: 17186 - DNA, 13 bp, Artificial Sequence
  Oligonucleotide probe
  misc_binding (1)..(13): Hybridization probe for the specific detection of wild-type HIV-1 at codon 163 of the integrase gene.
aaatyataggrca

SEQ ID NO: 17187 - DNA, 15 bp, Artificial Sequence
  Oligonucleotide probe
  misc_binding (1)..(15): Hybridization probe for the specific detection of wild-type HIV-1 at codon 163 of the integrase gene.
attataggrcaggta

SEQ ID NO: 17188 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (9)..(9): base is a locked nucleic acid
tacagrgacagcagagayc

SEQ ID NO: 17189 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (7)..(7): base is a locked nucleic acid
tacagrgacagcagagayc

SEQ ID NO: 17190 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (3)..(3): base is a locked nucleic acid
tacagrgacagcagagayc

SEQ ID NO: 17191 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (2)..(2): base is a locked nucleic acid
tacagrgacagcagagayc

SEQ ID NO: 17192 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (11)..(11): base is a locked nucleic acid
tacagrgacagcagagayc

SEQ ID NO: 17193 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (12)..(12): base is a locked nucleic acid
tacagrgacagcagagayc

SEQ ID NO: 17194 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (13)..(13): base is a locked nucleic acid
tacagrgacagcagagayc

SEQ ID NO: 17195 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (18)..(18): base is a locked nucleic acid
tacagrgacagcagagayc

SEQ ID NO: 17196 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (8)..(8): base is a locked nucleic acid
  modified_base (9)..(9): base is a locked nucleic acid
  modified_base (11)..(11): base is a locked nucleic acid
tacagrgacagcagagayc

SEQ ID NO: 17197 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (7)..(7): base is a locked nucleic acid
  modified_base (9)..(9): base is a locked nucleic acid
  modified_base (11)..(11): base is a locked nucleic acid
tacagrgacagcagagayc

SEQ ID NO: 17198 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (4)..(4): base is a locked nucleic acid
  modified_base (9)..(9): base is a locked nucleic acid
  modified_base (11)..(11): base is a locked nucleic acid
tacagrgacagcagagayc

SEQ ID NO: 17199 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (6)..(6): base is a locked nucleic acid
  modified_base (9)..(9): base is a locked nucleic acid
  modified_base (11)..(11): base is a locked nucleic acid
tacagrgacagcagagayc

SEQ ID NO: 17200 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (9)..(9): base is a locked nucleic acid
  modified_base (11)..(11): base is a locked nucleic acid
  modified_base (13)..(13): base is a locked nucleic acid
tacagrgacagcagagayc

SEQ ID NO: 17201 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (9)..(9): base is a locked nucleic acid
  modified_base (11)..(11): base is a locked nucleic acid
  modified_base (19)..(19): base is a locked nucleic acid
tacagrgacagcagagayc

SEQ ID NO: 17202 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (9)..(9): base is a locked nucleic acid
  modified_base (11)..(11): base is a locked nucleic acid
  modified_base (12)..(12): base is a locked nucleic acid
tacagrgacagcagagayc

SEQ ID NO: 17203 - DNA, 19 bp, Artificial Sequence
  Oligonucleotide probe
  misc_binding (1)..(19): Hybridization probe for the specific detection of wild-type HIV-1 at codon 230 of the integrase gene.
  modified_base (9)..(9): base is a locked nucleic acid
  modified_base (11)..(11): base is a locked nucleic acid
  modified_base (16)..(16): base is a locked nucleic acid
tacagrgacagcagagayc

SEQ ID NO: 17204 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (8)..(8): base is a locked nucleic acid
acagrgacagcagagay

SEQ ID NO: 17205 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (6)..(6): base is a locked nucleic acid
acagrgacagcagagay

SEQ ID NO: 17206 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (2)..(2): base is a locked nucleic acid
acagrgacagcagagay

SEQ ID NO: 17207 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (1)..(1): base is a locked nucleic acid
acagrgacagcagagay

SEQ ID NO: 17208 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (10)..(10): base is a locked nucleic acid
acagrgacagcagagay

SEQ ID NO: 17209 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (11)..(11): base is a locked nucleic acid
acagrgacagcagagay

SEQ ID NO: 17210 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (12)..(12): base is a locked nucleic acid
acagrgacagcagagay

SEQ ID NO: 17211 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (17)..(17): base is a locked nucleic acid
acagrgacagcagagay

SEQ ID NO: 17212 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (7)..(7): base is a locked nucleic acid
  modified_base (8)..(8): base is a locked nucleic acid
  modified_base (10)..(10): base is a locked nucleic acid
acagrgacagcagagay

SEQ ID NO: 17213 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (6)..(6): base is a locked nucleic acid
  modified_base (8)..(8): base is a locked nucleic acid
  modified_base (10)..(10): base is a locked nucleic acid
acagrgacagcagagay

SEQ ID NO: 17214 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (3)..(3): base is a locked nucleic acid
  modified_base (8)..(8): base is a locked nucleic acid
  modified_base (10)..(10): base is a locked nucleic acid
acagrgacagcagagay

SEQ ID NO: 17215 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (5)..(5): base is a locked nucleic acid
  modified_base (8)..(8): base is a locked nucleic acid
  modified_base (10)..(10): base is a locked nucleic acid
acagrgacagcagagay

SEQ ID NO: 17216 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (12)..(12): base is a locked nucleic acid
acagrgacagcagagay

SEQ ID NO: 17217 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (8)..(8): base is a locked nucleic acid
  modified_base (10)..(10): base is a locked nucleic acid
acagrgacagcagagay

SEQ ID NO: 17218 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (11)..(11): base is a locked nucleic acid
acagrgacagcagagay

SEQ ID NO: 17219 - DNA, 17 bp, Artificial Sequence
  Oligonucleotide probe
  misc_binding (1)..(17): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (15)..(15): base is a locked nucleic acid
acagrgacagcagagay

SEQ ID NO: 17220 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (8)..(8): base is a locked nucleic acid
acagrgacagcagag

SEQ ID NO: 17221 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (6)..(6): base is a locked nucleic acid
acagrgacagcagag

SEQ ID NO: 17222 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (2)..(2): base is a locked nucleic acid
acagrgacagcagag

SEQ ID NO: 17223 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (1)..(1): base is a locked nucleic acid
acagrgacagcagag

SEQ ID NO: 17224 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (10)..(10): base is a locked nucleic acid
acagrgacagcagag

SEQ ID NO: 17225 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (11)..(11): base is a locked nucleic acid
acagrgacagcagag

SEQ ID NO: 17226 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (12)..(12): base is a locked nucleic acid
acagrgacagcagag

SEQ ID NO: 17227 - DNA, 16 bp, Artificial Sequence
  Oligonucleotide probe
  misc_binding (1)..(16): Hybridization probe for the specific detection of wild-type HIV-1 at codon 230 of the integrase gene.
acagrgacagcagaga

SEQ ID NO: 17228 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (7)..(7): base is a locked nucleic acid
  modified_base (8)..(8): base is a locked nucleic acid
  modified_base (10)..(10): base is a locked nucleic acid
acagrgacagcagag

SEQ ID NO: 17229 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (6)..(6): base is a locked nucleic acid
  modified_base (8)..(8): base is a locked nucleic acid
  modified_base (10)..(10): base is a locked nucleic acid
acagrgacagcagag

SEQ ID NO: 17230 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (3)..(3): base is a locked nucleic acid
  modified_base (8)..(8): base is a locked nucleic acid
  modified_base (10)..(10): base is a locked nucleic acid
acagrgacagcagag

SEQ ID NO: 17231 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (5)..(5): base is a locked nucleic acid
  modified_base (8)..(8): base is a locked nucleic acid
  modified_base (10)..(10): base is a locked nucleic acid
acagrgacagcagag

SEQ ID NO: 17232 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (12)..(12): base is a locked nucleic acid
acagrgacagcagag

SEQ ID NO: 17233 - DNA, 16 bp, Artificial Sequence
  Oligonucleotide probe
  misc_binding (1)..(16): Hybridization probe for the specific detection of wild-type HIV-1 at codon 230 of the integrase gene.
  modified_base (8)..(8): base is a locked nucleic acid
  modified_base (10)..(10): base is a locked nucleic acid
acagrgacagcagaga

SEQ ID NO: 17234 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (11)..(11): base is a locked nucleic acid
acagrgacagcagag

SEQ ID NO: 17235 - DNA, 15 bp, Artificial Sequence
  Oligonucleotide probe
  misc_binding (1)..(15): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (15)..(15): base is a locked nucleic acid
acagrgacagcagag

SEQ ID NO: 17236 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (8)..(8): base is a locked nucleic acid
acagrgacagcag

SEQ ID NO: 17237 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (6)..(6): base is a locked nucleic acid
acagrgacagcag

SEQ ID NO: 17238 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (2)..(2): base is a locked nucleic acid
acagrgacagcag

SEQ ID NO: 17239 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (1)..(1): base is a locked nucleic acid
acagrgacagcag

SEQ ID NO: 17240 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (10)..(10): base is a locked nucleic acid
acagrgacagcag

SEQ ID NO: 17241 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (11)..(11): base is a locked nucleic acid
acagrgacagcag

SEQ ID NO: 17242 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (12)..(12): base is a locked nucleic acid
acagrgacagcag

SEQ ID NO: 17243 - DNA, 14 bp, Artificial Sequence
  Oligonucleotide probe
  misc_binding (1)..(14): Hybridization probe for the specific detection of wild-type HIV-1 at codon 230 of the integrase gene.
acagrgacagcaga

SEQ ID NO: 17244 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (7)..(7): base is a locked nucleic acid
  modified_base (8)..(8): base is a locked nucleic acid
  modified_base (10)..(10): base is a locked nucleic acid
acagrgacagcag

SEQ ID NO: 17245 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (6)..(6): base is a locked nucleic acid
  modified_base (8)..(8): base is a locked nucleic acid
  modified_base (10)..(10): base is a locked nucleic acid
acagrgacagcag

SEQ ID NO: 17246 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (3)..(3): base is a locked nucleic acid
  modified_base (8)..(8): base is a locked nucleic acid
  modified_base (10)..(10): base is a locked nucleic acid
acagrgacagcag

SEQ ID NO: 17247 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (5)..(5): base is a locked nucleic acid
  modified_base (8)..(8): base is a locked nucleic acid
  modified_base (10)..(10): base is a locked nucleic acid
acagrgacagcag

SEQ ID NO: 17248 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (12)..(12): base is a locked nucleic acid
acagrgacagcag

SEQ ID NO: 17249 - DNA, 14 bp, Artificial Sequence
  Oligonucleotide probe
  misc_binding (1)..(14): Hybridization probe for the specific detection of wild-type HIV-1 at codon 230 of the integrase gene.
  modified_base (8)..(8): base is a locked nucleic acid
  modified_base (10)..(10): base is a locked nucleic acid
acagrgacagcaga

SEQ ID NO: 17250 - DNA, 13 bp, Artificial Sequence
  Oligonucleotide probe
  misc_binding (1)..(13): Hybridization probe for the specific detection of wild-type HIV-1 at codon 230 of the integrase gene.
  modified_base (8)..(8): base is a locked nucleic acid
  modified_base (10)..(10): base is a locked nucleic acid
  modified_base (11)..(11): base is a locked nucleic acid
acagrgacagcag

SEQ ID NO: 17251 - DNA, 19 bp, Artificial Sequence
  Oligonucleotide probe
  misc_binding (1)..(19): Hybridization probe for the specific detection of wild-type HIV-1 at codon 230 of the integrase gene.
tacagrgacagcagagayc

SEQ ID NO: 17252 - DNA, 17 bp, Artificial Sequence
  Oligonucleotide probe
  misc_binding (1)..(17): Hybridization probe for the specific detection of wild-type HIV-1 at codon 230 of the integrase gene.
acagrgacagcagagay

SEQ ID NO: 17253 - DNA, 15 bp, Artificial Sequence
  Oligonucleotide probe
  misc_binding (1)..(15): Hybridization probe for the specific detection of wild-type HIV-1 at codon 230 of the integrase gene.
acagrgacagcagag

SEQ ID NO: 17254 - DNA, 13 bp, Artificial Sequence
  Oligonucleotide probe
  misc_binding (1)..(13): Hybridization probe for the specific detection of wild-type HIV-1 at codon 230 of the integrase gene.
acagrgacagcag

SEQ ID NO: 17255 - DNA, 15 bp, Artificial Sequence
  Oligonucleotide probe
  misc_binding (1)..(15): Hybridization probe for the specific detection of wild-type HIV-1 at codon 230 of the integrase gene.
agggacagcagagac

SEQ ID NO: 17256 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (8)..(8): base is a locked nucleic acid
trccaagragraaagyaaa

SEQ ID NO: 17257 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (7)..(7): base is a locked nucleic acid
trccaagragraaagyaaa

SEQ ID NO: 17258 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (3)..(3): base is a locked nucleic acid
trccaagragraaagyaaa

SEQ ID NO: 17259 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (4)..(4): base is a locked nucleic acid
trccaagragraaagyaaa

SEQ ID NO: 17260 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (15)..(15): base is a locked nucleic acid
trccaagragraaagyaaa

SEQ ID NO: 17261 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (17)..(17): base is a locked nucleic acid
trccaagragraaagyaaa

SEQ ID NO: 17262 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (14)..(14): base is a locked nucleic acid
trccaagragraaagyaaa

SEQ ID NO: 17263 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (12)..(12): base is a locked nucleic acid
trccaagragraaagyaaa

SEQ ID NO: 17264 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (3)..(3): base is a locked nucleic acid
  modified_base (9)..(9): base is a locked nucleic acid
  modified_base (11)..(11): base is a locked nucleic acid
trccaagragraaagyaaa

SEQ ID NO: 17265 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (4)..(4): base is a locked nucleic acid
  modified_base (9)..(9): base is a locked nucleic acid
  modified_base (11)..(11): base is a locked nucleic acid
trccaagragraaagyaaa

SEQ ID NO: 17266 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (7)..(7): base is a locked nucleic acid
  modified_base (9)..(9): base is a locked nucleic acid
  modified_base (11)..(11): base is a locked nucleic acid
trccaagragraaagyaaa

SEQ ID NO: 17267 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (8)..(8): base is a locked nucleic acid
  modified_base (9)..(9): base is a locked nucleic acid
  modified_base (11)..(11): base is a locked nucleic acid
trccaagragraaagyaaa

SEQ ID NO: 17268 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (9)..(9): base is a locked nucleic acid
  modified_base (11)..(11): base is a locked nucleic acid
  modified_base (16)..(16): base is a locked nucleic acid
trccaagragraaagyaaa

SEQ ID NO: 17269 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (9)..(9): base is a locked nucleic acid
  modified_base (11)..(11): base is a locked nucleic acid
  modified_base (14)..(14): base is a locked nucleic acid
trccaagragraaagyaaa

SEQ ID NO: 17270 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (9)..(9): base is a locked nucleic acid
  modified_base (11)..(11): base is a locked nucleic acid
  modified_base (15)..(15): base is a locked nucleic acid
trccaagragraaagyaaa

SEQ ID NO: 17271 - DNA, 19 bp, Artificial Sequence
  Oligonucleotide probe
  misc_binding (1)..(19): Hybridization probe for the specific detection of wild-type HIV-1 at codon 263 of the integrase gene.
  modified_base (9)..(9): base is a locked nucleic acid
  modified_base (11)..(11): base is a locked nucleic acid
  modified_base (12)..(12): base is a locked nucleic acid
trccaagragraaagyaaa

SEQ ID NO: 17272 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (7)..(7): base is a locked nucleic acid
rccaagragraaagyaa

SEQ ID NO: 17273 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (6)..(6): base is a locked nucleic acid
rccaagragraaagyaa

SEQ ID NO: 17274 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (2)..(2): base is a locked nucleic acid
rccaagragraaagyaa

SEQ ID NO: 17275 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (3)..(3): base is a locked nucleic acid
rccaagragraaagyaa

SEQ ID NO: 17276 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (14)..(14): base is a locked nucleic acid
rccaagragraaagyaa

SEQ ID NO: 17277 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (16)..(16): base is a locked nucleic acid
rccaagragraaagyaa

SEQ ID NO: 17278 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (13)..(13): base is a locked nucleic acid
rccaagragraaagyaa

SEQ ID NO: 17279 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (11)..(11): base is a locked nucleic acid
rccaagragraaagyaa

SEQ ID NO: 17280 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (2)..(2): base is a locked nucleic acid
  modified_base (8)..(8): base is a locked nucleic acid
  modified_base (10)..(10): base is a locked nucleic acid
rccaagragraaagyaa

SEQ ID NO: 17281 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (3)..(3): base is a locked nucleic acid
  modified_base (8)..(8): base is a locked nucleic acid
  modified_base (10)..(10): base is a locked nucleic acid
rccaagragraaagyaa

SEQ ID NO: 17282 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (6)..(6): base is a locked nucleic acid
  modified_base (8)..(8): base is a locked nucleic acid
  modified_base (10)..(10): base is a locked nucleic acid
rccaagragraaagyaa

SEQ ID NO: 17283 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (7)..(7): base is a locked nucleic acid
  modified_base (8)..(8): base is a locked nucleic acid
  modified_base (10)..(10): base is a locked nucleic acid
rccaagragraaagyaa

SEQ ID NO: 17284 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (15)..(15): base is a locked nucleic acid
rccaagragraaagyaa

SEQ ID NO: 17285 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (13)..(13): base is a locked nucleic acid
rccaagragraaagyaa

SEQ ID NO: 17286 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (14)..(14): base is a locked nucleic acid
rccaagragraaagyaa

SEQ ID NO: 17287 - DNA, 17 bp, Artificial Sequence
  Oligonucleotide probe
  misc_binding (1)..(17): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (11)..(11): base is a locked nucleic acid
rccaagragraaagyaa

SEQ ID NO: 17288 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (7)..(7): base is a locked nucleic acid
rccaagragraaagy

SEQ ID NO: 17289 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (6)..(6): base is a locked nucleic acid
rccaagragraaagy

SEQ ID NO: 17290 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (2)..(2): base is a locked nucleic acid
rccaagragraaagy

SEQ ID NO: 17291 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (3)..(3): base is a locked nucleic acid
rccaagragraaagy

SEQ ID NO: 17292 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (14)..(14): base is a locked nucleic acid
rccaagragraaagy

SEQ ID NO: 17293 - DNA, 15 bp, Artificial Sequence
  Oligonucleotide probe
  misc_binding (1)..(15): Hybridization probe for the specific detection of wild-type HIV-1 at codon 263 of the integrase gene.
rccaagragraaagy

SEQ ID NO: 17294 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (13)..(13): base is a locked nucleic acid
rccaagragraaagy

SEQ ID NO: 17295 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (11)..(11): base is a locked nucleic acid
rccaagragraaagy

SEQ ID NO: 17296 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (2)..(2): base is a locked nucleic acid
  modified_base (8)..(8): base is a locked nucleic acid
  modified_base (10)..(10): base is a locked nucleic acid
rccaagragraaagy

SEQ ID NO: 17297 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (3)..(3): base is a locked nucleic acid
  modified_base (8)..(8): base is a locked nucleic acid
  modified_base (10)..(10): base is a locked nucleic acid
rccaagragraaagy

SEQ ID NO: 17298 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (6)..(6): base is a locked nucleic acid
  modified_base (8)..(8): base is a locked nucleic acid
  modified_base (10)..(10): base is a locked nucleic acid
rccaagragraaagy

SEQ ID NO: 17299 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (7)..(7): base is a locked nucleic acid
  modified_base (8)..(8): base is a locked nucleic acid
  modified_base (10)..(10): base is a locked nucleic acid
rccaagragraaagy

SEQ ID NO: 17300 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (15)..(15): base is a locked nucleic acid
rccaagragraaagy

SEQ ID NO: 17301 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (13)..(13): base is a locked nucleic acid
rccaagragraaagy

SEQ ID NO: 17302 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (14)..(14): base is a locked nucleic acid
rccaagragraaagy

SEQ ID NO: 17303 - DNA, 15 bp, Artificial Sequence
  Oligonucleotide probe
  misc_binding (1)..(15): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (11)..(11): base is a locked nucleic acid
rccaagragraaagy

SEQ ID NO: 17304 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (7)..(7): base is a locked nucleic acid
rccaagragraaa

SEQ ID NO: 17305 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (6)..(6): base is a locked nucleic acid
rccaagragraaa

SEQ ID NO: 17306 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (2)..(2): base is a locked nucleic acid
rccaagragraaa

SEQ ID NO: 17307 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (3)..(3): base is a locked nucleic acid
rccaagragraaa

SEQ ID NO: 17308 - DNA, 13 bp, Artificial Sequence
  Oligonucleotide probe
  misc_binding (1)..(13): Hybridization probe for the specific detection of wild-type HIV-1 at codon 263 of the integrase gene.
rccaagragraaa

SEQ ID NO: 17309 - DNA, 14 bp, Artificial Sequence
  Oligonucleotide probe
  misc_binding (1)..(14): Hybridization probe for the specific detection of wild-type HIV-1 at codon 263 of the integrase gene.
rccaagragraaag

SEQ ID NO: 17310 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (13)..(13): base is a locked nucleic acid
rccaagragraaa

SEQ ID NO: 17311 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (11)..(11): base is a locked nucleic acid
rccaagragraaa

SEQ ID NO: 17312 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (2)..(2): base is a locked nucleic acid
  modified_base (8)..(8): base is a locked nucleic acid
  modified_base (10)..(10): base is a locked nucleic acid
rccaagragraaa

SEQ ID NO: 17313 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (3)..(3): base is a locked nucleic acid
  modified_base (8)..(8): base is a locked nucleic acid
  modified_base (10)..(10): base is a locked nucleic acid
rccaagragraaa

SEQ ID NO: 17314 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (6)..(6): base is a locked nucleic acid
  modified_base (8)..(8): base is a locked nucleic acid
  modified_base (10)..(10): base is a locked nucleic acid
rccaagragraaa

SEQ ID NO: 17315 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (7)..(7): base is a locked nucleic acid
  modified_base (8)..(8): base is a locked nucleic acid
  modified_base (10)..(10): base is a locked nucleic acid
rccaagragraaa

SEQ ID NO: 17316 - DNA, 14 bp, Artificial Sequence
  Oligonucleotide probe
  misc_binding (1)..(14): Hybridization probe for the specific detection of wild-type HIV-1 at codon 263 of the integrase gene.
  modified_base (8)..(8): base is a locked nucleic acid
  modified_base (10)..(10): base is a locked nucleic acid
rccaagragraaag

SEQ ID NO: 17317 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (13)..(13): base is a locked nucleic acid
rccaagragraaa

SEQ ID NO: 17318 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (8)..(8): base is a locked nucleic acid
  modified_base (10)..(10): base is a locked nucleic acid
rccaagragraaa

SEQ ID NO: 17319 - DNA, 13 bp, Artificial Sequence
  Oligonucleotide probe
  misc_binding (1)..(13): Hybridization probe for the specific detection of wild-type HIV-1 at codon 263 of the integrase gene.
  modified_base (8)..(8): base is a locked nucleic acid
  modified_base (10)..(10): base is a locked nucleic acid
  modified_base (11)..(11): base is a locked nucleic acid
rccaagragraaa

SEQ ID NO: 17320 - DNA, 19 bp, Artificial Sequence
  Oligonucleotide probe
  misc_binding (1)..(19): Hybridization probe for the specific detection of wild-type HIV-1 at codon 263 of the integrase gene.
trccaagragraaagyaaa

SEQ ID NO: 17321 - DNA, 17 bp, Artificial Sequence
  Oligonucleotide probe
  misc_binding (1)..(17): Hybridization probe for the specific detection of wild-type HIV-1 at codon 263 of the integrase gene.
rccaagragraaagyaa

SEQ ID NO: 17322 - DNA, 15 bp, Artificial Sequence
  Oligonucleotide probe
  misc_binding (1)..(15): Hybridization probe for the specific detection of wild-type HIV-1 at codon 263 of the integrase gene.
rccaagragraaagy

SEQ ID NO: 17323 - DNA, 13 bp, Artificial Sequence
  Oligonucleotide probe
  misc_binding (1)..(13): Hybridization probe for the specific detection of wild-type HIV-1 at codon 263 of the integrase gene.
rccaagragraaa

SEQ ID NO: 17324 - DNA, 15 bp, Artificial Sequence
  Oligonucleotide probe
  misc_binding (1)..(15): Hybridization probe for the specific detection of wild-type HIV-1 at codon 263 of the integrase gene.
ccaagaagraaagca

SEQ ID NO: 17325 - DNA, 15 bp, Artificial Sequence
  Oligonucleotide probe
  misc_binding (1)..(15): Hybridization probe for the specific detection of mutant HIV-1 at codon 51 of the integrase gene.
agccatgtatggaca

SEQ ID NO: 17326 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
ytagaytgycacayytag

SEQ ID NO: 17327 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (8)..(8): base is a locked nucleic acid
ytagaytgycacayytag

SEQ ID NO: 17328 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (2)..(2): base is a locked nucleic acid
ytagaytgycacayytag

SEQ ID NO: 17329 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (7)..(7): base is a locked nucleic acid
ytagaytgycacayytag

SEQ ID NO: 17330 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (3)..(3): base is a locked nucleic acid
ytagaytgycacayytag

SEQ ID NO: 17331 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (14)..(14): base is a locked nucleic acid
ytagaytgycacayytag

SEQ ID NO: 17332 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (16)..(16): base is a locked nucleic acid
ytagaytgycacayytag

SEQ ID NO: 17333 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (10)..(10): base is a locked nucleic acid
ytagaytgycacayytag

SEQ ID NO: 17334 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (13)..(13): base is a locked nucleic acid
ytagaytgycacayytag

SEQ ID NO: 17335 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (5)..(5): base is a locked nucleic acid
  modified_base (9)..(9): base is a locked nucleic acid
  modified_base (10)..(10): base is a locked nucleic acid
ytagaytgycacayytag

SEQ ID NO: 17336 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (3)..(3): base is a locked nucleic acid
  modified_base (9)..(9): base is a locked nucleic acid
  modified_base (10)..(10): base is a locked nucleic acid
ytagaytgycacayytag

SEQ ID NO: 17337 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (10)..(10): base is a locked nucleic acid
ytagaytgycacayytag

SEQ ID NO: 17338 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (4)..(4): base is a locked nucleic acid
  modified_base (9)..(9): base is a locked nucleic acid
  modified_base (10)..(10): base is a locked nucleic acid
ytagaytgycacayytag

SEQ ID NO: 17339 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (13)..(13): base is a locked nucleic acid
ytagaytgycacayytag

SEQ ID NO: 17340 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (12)..(12): base is a locked nucleic acid
ytagaytgycacayytag

SEQ ID NO: 17341 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (15)..(15): base is a locked nucleic acid
ytagaytgycacayytag

SEQ ID NO: 17342 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (16)..(16): base is a locked nucleic acid
ytagaytgycacayytag

SEQ ID NO: 17343 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
tagaytgyaacayytaga

SEQ ID NO: 17344 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (7)..(7): base is a locked nucleic acid
tagaytgyaacayytaga

SEQ ID NO: 17345 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (5)..(5): base is a locked nucleic acid
tagaytgyaacayytaga

SEQ ID NO: 17346 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (8)..(8): base is a locked nucleic acid
tagaytgyaacayytaga

SEQ ID NO: 17347 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (3)..(3): base is a locked nucleic acid
tagaytgyaacayytaga

SEQ ID NO: 17348 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (12)..(12): base is a locked nucleic acid
tagaytgyaacayytaga

SEQ ID NO: 17349 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (16)..(16): base is a locked nucleic acid
tagaytgyaacayytaga

SEQ ID NO: 17350 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (10)..(10): base is a locked nucleic acid
tagaytgyaacayytaga

SEQ ID NO: 17351 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (14)..(14): base is a locked nucleic acid
tagaytgyaacayytaga

SEQ ID NO: 17352 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (7)..(7): base is a locked nucleic acid
  modified_base (9)..(9): base is a locked nucleic acid
  modified_base (10)..(10): base is a locked nucleic acid
tagaytgyaacayytaga

SEQ ID NO: 17353 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (6)..(6): base is a locked nucleic acid
  modified_base (9)..(9): base is a locked nucleic acid
  modified_base (10)..(10): base is a locked nucleic acid
tagaytgyaacayytaga

SEQ ID NO: 17354 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (2)..(2): base is a locked nucleic acid
  modified_base (9)..(9): base is a locked nucleic acid
  modified_base (10)..(10): base is a locked nucleic acid
tagaytgyaacayytaga

SEQ ID NO: 17355 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (3)..(3): base is a locked nucleic acid
  modified_base (9)..(9): base is a locked nucleic acid
  modified_base (10)..(10): base is a locked nucleic acid
tagaytgyaacayytaga

SEQ ID NO: 17356 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (17)..(17): base is a locked nucleic acid
tagaytgyaacayytaga

SEQ ID NO: 17357 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (16)..(16): base is a locked nucleic acid
tagaytgyaacayytaga

SEQ ID NO: 17358 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (13)..(13): base is a locked nucleic acid
tagaytgyaacayytaga

SEQ ID NO: 17359 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (15)..(15): base is a locked nucleic acid
tagaytgyaacayytaga

SEQ ID NO: 17360 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (6)..(6): base is a locked nucleic acid
tagaytgyaacayytaga

SEQ ID NO: 17361 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (17)..(17): base is a locked nucleic acid
tagaytgyaacayytaga

SEQ ID NO: 17362 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (11)..(11): base is a locked nucleic acid
tagaytgyaacayytaga

SEQ ID NO: 17363 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (13)..(13): base is a locked nucleic acid
tagaytgyaacayytaga

SEQ ID NO: 17364 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (5)..(5): base is a locked nucleic acid
  modified_base (9)..(9): base is a locked nucleic acid
  modified_base (10)..(10): base is a locked nucleic acid
tagaytgyaacayytaga

SEQ ID NO: 17365 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (10)..(10): base is a locked nucleic acid
tagaytgyaacayytaga

SEQ ID NO: 17366 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (11)..(11): base is a locked nucleic acid
tagaytgyaacayytaga

SEQ ID NO: 17367 - DNA, 18 bp, Artificial Sequence
  Oligonucleotide probe
  misc_binding (1)..(18): Hybridization probe for the specific detection of mutant HIV-1 at codon 66 of the integrase gene.
  modified_base (9)..(9): base is a locked nucleic acid
  modified_base (10)..(10): base is a locked nucleic acid
  modified_base (14)..(14): base is a locked nucleic acid
tagaytgyaacayytaga

SEQ ID NO: 17368 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
tagaytgycacayytag

SEQ ID NO: 17369 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (7)..(7): base is a locked nucleic acid
tagaytgycacayytag

SEQ ID NO: 17370 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (1)..(1): base is a locked nucleic acid
tagaytgycacayytag

SEQ ID NO: 17371 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (6)..(6): base is a locked nucleic acid
tagaytgycacayytag

SEQ ID NO: 17372 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (2)..(2): base is a locked nucleic acid
tagaytgycacayytag

SEQ ID NO: 17373 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (13)..(13): base is a locked nucleic acid
tagaytgycacayytag

SEQ ID NO: 17374 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (15)..(15): base is a locked nucleic acid
tagaytgycacayytag

SEQ ID NO: 17375 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (9)..(9): base is a locked nucleic acid
tagaytgycacayytag

SEQ ID NO: 17376 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (12)..(12): base is a locked nucleic acid
tagaytgycacayytag

SEQ ID NO: 17377 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (4)..(4): base is a locked nucleic acid
  modified_base (8)..(8): base is a locked nucleic acid
  modified_base (9)..(9): base is a locked nucleic acid
tagaytgycacayytag

SEQ ID NO: 17378 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (2)..(2): base is a locked nucleic acid
  modified_base (8)..(8): base is a locked nucleic acid
  modified_base (9)..(9): base is a locked nucleic acid
tagaytgycacayytag

SEQ ID NO: 17379 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (7)..(7): base is a locked nucleic acid
  modified_base (8)..(8): base is a locked nucleic acid
  modified_base (9)..(9): base is a locked nucleic acid
tagaytgycacayytag

SEQ ID NO: 17380 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (3)..(3): base is a locked nucleic acid
  modified_base (8)..(8): base is a locked nucleic acid
  modified_base (9)..(9): base is a locked nucleic acid
tagaytgycacayytag

SEQ ID NO: 17381 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (12)..(12): base is a locked nucleic acid
tagaytgycacayytag

SEQ ID NO: 17382 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (11)..(11): base is a locked nucleic acid
tagaytgycacayytag

SEQ ID NO: 17383 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (14)..(14): base is a locked nucleic acid
tagaytgycacayytag

SEQ ID NO: 17384 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (15)..(15): base is a locked nucleic acid
tagaytgycacayytag

SEQ ID NO: 17385 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
agaytgyaacayytaga

SEQ ID NO: 17386 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (6)..(6): base is a locked nucleic acid
agaytgyaacayytaga

SEQ ID NO: 17387 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (4)..(4): base is a locked nucleic acid
agaytgyaacayytaga

SEQ ID NO: 17388 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (7)..(7): base is a locked nucleic acid
agaytgyaacayytaga

SEQ ID NO: 17389 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (2)..(2): base is a locked nucleic acid
agaytgyaacayytaga

SEQ ID NO: 17390 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (11)..(11): base is a locked nucleic acid
agaytgyaacayytaga

SEQ ID NO: 17391 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (15)..(15): base is a locked nucleic acid
agaytgyaacayytaga

SEQ ID NO: 17392 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (9)..(9): base is a locked nucleic acid
agaytgyaacayytaga

SEQ ID NO: 17393 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (13)..(13): base is a locked nucleic acid
agaytgyaacayytaga

SEQ ID NO: 17394 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (6)..(6): base is a locked nucleic acid
  modified_base (8)..(8): base is a locked nucleic acid
  modified_base (9)..(9): base is a locked nucleic acid
agaytgyaacayytaga

SEQ ID NO: 17395 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (5)..(5): base is a locked nucleic acid
  modified_base (8)..(8): base is a locked nucleic acid
  modified_base (9)..(9): base is a locked nucleic acid
agaytgyaacayytaga

SEQ ID NO: 17396 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (1)..(1): base is a locked nucleic acid
  modified_base (8)..(8): base is a locked nucleic acid
  modified_base (9)..(9): base is a locked nucleic acid
agaytgyaacayytaga

SEQ ID NO: 17397 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (2)..(2): base is a locked nucleic acid
  modified_base (8)..(8): base is a locked nucleic acid
  modified_base (9)..(9): base is a locked nucleic acid
agaytgyaacayytaga

SEQ ID NO: 17398 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (16)..(16): base is a locked nucleic acid
agaytgyaacayytaga

SEQ ID NO: 17399 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (15)..(15): base is a locked nucleic acid
agaytgyaacayytaga

SEQ ID NO: 17400 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (12)..(12): base is a locked nucleic acid
agaytgyaacayytaga

SEQ ID NO: 17401 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (14)..(14): base is a locked nucleic acid
agaytgyaacayytaga

SEQ ID NO: 17402 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (5)..(5): base is a locked nucleic acid
agaytgyaacayytaga

SEQ ID NO: 17403 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (16)..(16): base is a locked nucleic acid
agaytgyaacayytaga

SEQ ID NO: 17404 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (10)..(10): base is a locked nucleic acid
agaytgyaacayytaga

SEQ ID NO: 17405 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (12)..(12): base is a locked nucleic acid
agaytgyaacayytaga

SEQ ID NO: 17406 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (4)..(4): base is a locked nucleic acid
  modified_base (8)..(8): base is a locked nucleic acid
  modified_base (9)..(9): base is a locked nucleic acid
agaytgyaacayytaga

SEQ ID NO: 17407 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (7)..(7): base is a locked nucleic acid
  modified_base (8)..(8): base is a locked nucleic acid
  modified_base (9)..(9): base is a locked nucleic acid
agaytgyaacayytaga

SEQ ID NO: 17408 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (10)..(10): base is a locked nucleic acid
agaytgyaacayytaga

SEQ ID NO: 17409 - DNA, 17 bp, Artificial Sequence
  Oligonucleotide probe
  misc_binding (1)..(17): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (13)..(13): base is a locked nucleic acid
agaytgyaacayytaga

SEQ ID NO: 17410 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
tagaytgycacayyt

SEQ ID NO: 17411 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (7)..(7): base is a locked nucleic acid
tagaytgycacayyt

SEQ ID NO: 17412 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (1)..(1): base is a locked nucleic acid
tagaytgycacayyt

SEQ ID NO: 17413 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (6)..(6): base is a locked nucleic acid
tagaytgycacayyt

SEQ ID NO: 17414 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (2)..(2): base is a locked nucleic acid
tagaytgycacayyt

SEQ ID NO: 17415 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (13)..(13): base is a locked nucleic acid
tagaytgycacayyt

SEQ ID NO: 17416 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (15)..(15): base is a locked nucleic acid
tagaytgycacayyt

SEQ ID NO: 17417 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (9)..(9): base is a locked nucleic acid
tagaytgycacayyt

SEQ ID NO: 17418 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (12)..(12): base is a locked nucleic acid
tagaytgycacayyt

SEQ ID NO: 17419 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (4)..(4): base is a locked nucleic acid
  modified_base (8)..(8): base is a locked nucleic acid
  modified_base (9)..(9): base is a locked nucleic acid
tagaytgycacayyt

SEQ ID NO: 17420 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (2)..(2): base is a locked nucleic acid
  modified_base (8)..(8): base is a locked nucleic acid
  modified_base (9)..(9): base is a locked nucleic acid
tagaytgycacayyt

SEQ ID NO: 17421 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (7)..(7): base is a locked nucleic acid
  modified_base (8)..(8): base is a locked nucleic acid
  modified_base (9)..(9): base is a locked nucleic acid
tagaytgycacayyt

SEQ ID NO: 17422 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (3)..(3): base is a locked nucleic acid
  modified_base (8)..(8): base is a locked nucleic acid
  modified_base (9)..(9): base is a locked nucleic acid
tagaytgycacayyt

SEQ ID NO: 17423 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (12)..(12): base is a locked nucleic acid
tagaytgycacayyt

SEQ ID NO: 17424 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (11)..(11): base is a locked nucleic acid
tagaytgycacayyt

SEQ ID NO: 17425 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (14)..(14): base is a locked nucleic acid
tagaytgycacayyt

SEQ ID NO: 17426 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (15)..(15): base is a locked nucleic acid
tagaytgycacayyt

SEQ ID NO: 17427 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
agaytgyaacayyta

SEQ ID NO: 17428 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (6)..(6): base is a locked nucleic acid
agaytgyaacayyta

SEQ ID NO: 17429 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (4)..(4): base is a locked nucleic acid
agaytgyaacayyta

SEQ ID NO: 17430 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (7)..(7): base is a locked nucleic acid
agaytgyaacayyta

SEQ ID NO: 17431 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (2)..(2): base is a locked nucleic acid
agaytgyaacayyta

SEQ ID NO: 17432 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (11)..(11): base is a locked nucleic acid
agaytgyaacayyta

SEQ ID NO: 17433 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (15)..(15): base is a locked nucleic acid
agaytgyaacayyta

SEQ ID NO: 17434 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (9)..(9): base is a locked nucleic acid
agaytgyaacayyta

SEQ ID NO: 17435 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (13)..(13): base is a locked nucleic acid
agaytgyaacayyta

SEQ ID NO: 17436 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (6)..(6): base is a locked nucleic acid
  modified_base (8)..(8): base is a locked nucleic acid
  modified_base (9)..(9): base is a locked nucleic acid
agaytgyaacayyta

SEQ ID NO: 17437 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (5)..(5): base is a locked nucleic acid
  modified_base (8)..(8): base is a locked nucleic acid
  modified_base (9)..(9): base is a locked nucleic acid
agaytgyaacayyta

SEQ ID NO: 17438 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (1)..(1): base is a locked nucleic acid
  modified_base (8)..(8): base is a locked nucleic acid
  modified_base (9)..(9): base is a locked nucleic acid
agaytgyaacayyta

SEQ ID NO: 17439 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (2)..(2): base is a locked nucleic acid
  modified_base (8)..(8): base is a locked nucleic acid
  modified_base (9)..(9): base is a locked nucleic acid
agaytgyaacayyta

SEQ ID NO: 17440 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
agaytgyaacayyta

SEQ ID NO: 17441 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (15)..(15): base is a locked nucleic acid
agaytgyaacayyta

SEQ ID NO: 17442 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (12)..(12): base is a locked nucleic acid
agaytgyaacayyta

SEQ ID NO: 17443 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (14)..(14): base is a locked nucleic acid
agaytgyaacayyta

SEQ ID NO: 17444 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (5)..(5): base is a locked nucleic acid
agaytgyaacayyta

SEQ ID NO: 17445 - DNA, 15 bp, Artificial Sequence
  Oligonucleotide probe
  misc_binding (1)..(15): Hybridization probe for the specific detection of mutant HIV-1 at codon 66 of the integrase gene.
agaytgyaacayyta

SEQ ID NO: 17446 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (10)..(10): base is a locked nucleic acid
agaytgyaacayyta

SEQ ID NO: 17447 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (12)..(12): base is a locked nucleic acid
agaytgyaacayyta

SEQ ID NO: 17448 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (4)..(4): base is a locked nucleic acid
  modified_base (8)..(8): base is a locked nucleic acid
  modified_base (9)..(9): base is a locked nucleic acid
agaytgyaacayyta

SEQ ID NO: 17449 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (7)..(7): base is a locked nucleic acid
  modified_base (8)..(8): base is a locked nucleic acid
  modified_base (9)..(9): base is a locked nucleic acid
agaytgyaacayyta

SEQ ID NO: 17450 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (10)..(10): base is a locked nucleic acid
agaytgyaacayyta

SEQ ID NO: 17451 - DNA, 15 bp, Artificial Sequence
  Oligonucleotide probe
  misc_binding (1)..(15): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (13)..(13): base is a locked nucleic acid
agaytgyaacayyta

SEQ ID NO: 17452 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
tagaytgycacay

SEQ ID NO: 17453 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (7)..(7): base is a locked nucleic acid
tagaytgycacay

SEQ ID NO: 17454 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (1)..(1): base is a locked nucleic acid
tagaytgycacay

SEQ ID NO: 17455 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (6)..(6): base is a locked nucleic acid
tagaytgycacay

SEQ ID NO: 17456 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (2)..(2): base is a locked nucleic acid
tagaytgycacay

SEQ ID NO: 17457 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (13)..(13): base is a locked nucleic acid
tagaytgycacay

SEQ ID NO: 17458 - DNA, 14 bp, Artificial Sequence
  Oligonucleotide probe
  misc_binding (1)..(14): Hybridization probe for the specific detection of mutant HIV-1 at codon 66 of the integrase gene.
tagaytgycacayy

SEQ ID NO: 17459 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (9)..(9): base is a locked nucleic acid
tagaytgycacay

SEQ ID NO: 17460 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (12)..(12): base is a locked nucleic acid
tagaytgycacay

SEQ ID NO: 17461 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (4)..(4): base is a locked nucleic acid
  modified_base (8)..(8): base is a locked nucleic acid
  modified_base (9)..(9): base is a locked nucleic acid
tagaytgycacay

SEQ ID NO: 17462 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (2)..(2): base is a locked nucleic acid
  modified_base (8)..(8): base is a locked nucleic acid
  modified_base (9)..(9): base is a locked nucleic acid
tagaytgycacay

SEQ ID NO: 17463 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (7)..(7): base is a locked nucleic acid
  modified_base (8)..(8): base is a locked nucleic acid
  modified_base (9)..(9): base is a locked nucleic acid
tagaytgycacay

SEQ ID NO: 17464 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (3)..(3): base is a locked nucleic acid
  modified_base (8)..(8): base is a locked nucleic acid
  modified_base (9)..(9): base is a locked nucleic acid
tagaytgycacay

SEQ ID NO: 17465 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (12)..(12): base is a locked nucleic acid
tagaytgycacay

SEQ ID NO: 17466 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (11)..(11): base is a locked nucleic acid
tagaytgycacay

SEQ ID NO: 17467 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
tagaytgycacay

SEQ ID NO: 17468 - DNA, 14 bp, Artificial Sequence
  Oligonucleotide probe
  misc_binding (1)..(14): Hybridization probe for the specific detection of mutant HIV-1 at codon 66 of the integrase gene.
  modified_base (8)..(8): base is a locked nucleic acid
  modified_base (9)..(9): base is a locked nucleic acid
tagaytgycacayy

SEQ ID NO: 17469 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
agaytgyaacayy

SEQ ID NO: 17470 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (6)..(6): base is a locked nucleic acid
agaytgyaacayy

SEQ ID NO: 17471 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (4)..(4): base is a locked nucleic acid
agaytgyaacayy

SEQ ID NO: 17472 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (7)..(7): base is a locked nucleic acid
agaytgyaacayy

SEQ ID NO: 17473 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (2)..(2): base is a locked nucleic acid
agaytgyaacayy

SEQ ID NO: 17474 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (11)..(11): base is a locked nucleic acid
agaytgyaacayy

SEQ ID NO: 17475 - DNA, 14 bp, Artificial Sequence
  Oligonucleotide probe
  misc_binding (1)..(14): Hybridization probe for the specific detection of mutant HIV-1 at codon 66 of the integrase gene.
agaytgyaacayyt

SEQ ID NO: 17476 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (9)..(9): base is a locked nucleic acid
agaytgyaacayy

SEQ ID NO: 17477 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (13)..(13): base is a locked nucleic acid
agaytgyaacayy

SEQ ID NO: 17478 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (6)..(6): base is a locked nucleic acid
  modified_base (8)..(8): base is a locked nucleic acid
  modified_base (9)..(9): base is a locked nucleic acid
agaytgyaacayy

SEQ ID NO: 17479 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (5)..(5): base is a locked nucleic acid
  modified_base (8)..(8): base is a locked nucleic acid
  modified_base (9)..(9): base is a locked nucleic acid
agaytgyaacayy

SEQ ID NO: 17480 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (1)..(1): base is a locked nucleic acid
  modified_base (8)..(8): base is a locked nucleic acid
  modified_base (9)..(9): base is a locked nucleic acid
agaytgyaacayy

SEQ ID NO: 17481 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (2)..(2): base is a locked nucleic acid
  modified_base (8)..(8): base is a locked nucleic acid
  modified_base (9)..(9): base is a locked nucleic acid
agaytgyaacayy

SEQ ID NO: 17482 - DNA, 14 bp, Artificial Sequence
  Oligonucleotide probe
  misc_binding (1)..(14): Hybridization probe for the specific detection of mutant HIV-1 at codon 66 of the integrase gene.
  modified_base (8)..(8): base is a locked nucleic acid
  modified_base (9)..(9): base is a locked nucleic acid
agaytgyaacayyt

SEQ ID NO: 17483 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (12)..(12): base is a locked nucleic acid
agaytgyaacayy

SEQ ID NO: 17484 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
agaytgyaacayy

SEQ ID NO: 17485 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (5)..(5): base is a locked nucleic acid
agaytgyaacayy

SEQ ID NO: 17486 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (10)..(10): base is a locked nucleic acid
agaytgyaacayy

SEQ ID NO: 17487 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (12)..(12): base is a locked nucleic acid
agaytgyaacayy

SEQ ID NO: 17488 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (4)..(4): base is a locked nucleic acid
  modified_base (8)..(8): base is a locked nucleic acid
  modified_base (9)..(9): base is a locked nucleic acid
agaytgyaacayy

SEQ ID NO: 17489 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (7)..(7): base is a locked nucleic acid
  modified_base (8)..(8): base is a locked nucleic acid
  modified_base (9)..(9): base is a locked nucleic acid
agaytgyaacayy

SEQ ID NO: 17490 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (10)..(10): base is a locked nucleic acid
agaytgyaacayy

SEQ ID NO: 17491 - DNA, 13 bp, Artificial Sequence
  Oligonucleotide probe
  misc_binding (1)..(13): Hybridization probe for the specific detection of mutant HIV-1 at codon 66 of the integrase gene.
  modified_base (8)..(8): base is a locked nucleic acid
  modified_base (9)..(9): base is a locked nucleic acid
  modified_base (13)..(13): base is a locked nucleic acid
agaytgyaacayy

SEQ ID NO: 17492 - DNA, 18 bp, Artificial Sequence
  Oligonucleotide probe
  misc_binding (1)..(18): Hybridization probe for the specific detection of mutant HIV-1 at codon 66 of the integrase gene.
ytagaytgycacayytag

SEQ ID NO: 17493 - DNA, 18 bp, Artificial Sequence
  Oligonucleotide probe
  misc_binding (1)..(18): Hybridization probe for the specific detection of mutant HIV-1 at codon 66 of the integrase gene.
tagaytgyaacayytaga

SEQ ID NO: 17494 - DNA, 17 bp, Artificial Sequence
  Oligonucleotide probe
  misc_binding (1)..(17): Hybridization probe for the specific detection of mutant HIV-1 at codon 66 of the integrase gene.
tagaytgycacayytag

SEQ ID NO: 17495 - DNA, 17 bp, Artificial Sequence
  Oligonucleotide probe
  misc_binding (1)..(17): Hybridization probe for the specific detection of mutant HIV-1 at codon 66 of the integrase gene.
agaytgyaacayytaga

SEQ ID NO: 17496 - DNA, 15 bp, Artificial Sequence
  Oligonucleotide probe
  misc_binding (1)..(15): Hybridization probe for the specific detection of mutant HIV-1 at codon 66 of the integrase gene.
tagaytgycacayyt

SEQ ID NO: 17497 - DNA, 15 bp, Artificial Sequence
  Oligonucleotide probe
  misc_binding (1)..(15): Hybridization probe for the specific detection of mutant HIV-1 at codon 66 of the integrase gene.
agaytgyaacayyta

SEQ ID NO: 17498 - DNA, 13 bp, Artificial Sequence
  Oligonucleotide probe
  misc_binding (1)..(13): Hybridization probe for the specific detection of mutant HIV-1 at codon 66 of the integrase gene.
tagaytgycacay

SEQ ID NO: 17499 - DNA, 13 bp, Artificial Sequence
  Oligonucleotide probe
  misc_binding (1)..(13): Hybridization probe for the specific detection of mutant HIV-1 at codon 66 of the integrase gene.
agaytgyaacayy

SEQ ID NO: 17500 - DNA, 15 bp, Artificial Sequence
  Oligonucleotide probe
  misc_binding (1)..(15): Hybridization probe for the specific detection of mutant HIV-1 at codon 66 of the integrase gene.
taaatgkatacaatc

SEQ ID NO: 17501 - DNA, 15 bp, Artificial Sequence
  Oligonucleotide probe
  misc_binding (1)..(15): Hybridization probe for the specific detection of mutant HIV-1 at codon 66 of the integrase gene.
taaatgkgcacaatc

SEQ ID NO: 17502 - DNA, 15 bp, Artificial Sequence
  Oligonucleotide probe
  misc_binding (1)..(15): Hybridization probe for the specific detection of mutant HIV-1 at codon 66 of the integrase gene.
taaatgtttacaatc

SEQ ID NO: 17503 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (9)..(9): base is a locked nucleic acid
  modified_base (10)..(10): base is a locked nucleic acid
aaarthatytrgtagcag

SEQ ID NO: 17504 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (4)..(4): base is a locked nucleic acid
aaarthatytrgtagcag

SEQ ID NO: 17505 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (2)..(2): base is a locked nucleic acid
aaarthatytrgtagcag

SEQ ID NO: 17506 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (3)..(3): base is a locked nucleic acid
aaarthatytrgtagcag

SEQ ID NO: 17507 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (7)..(7): base is a locked nucleic acid
aaarthatytrgtagcag

SEQ ID NO: 17508 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (12)..(12): base is a locked nucleic acid
aaarthatytrgtagcag

SEQ ID NO: 17509 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (17)..(17): base is a locked nucleic acid
aaarthatytrgtagcag

SEQ ID NO: 17510 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (16)..(16): base is a locked nucleic acid
aaarthatytrgtagcag

SEQ ID NO: 17511 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (18)..(18): base is a locked nucleic acid
aaarthatytrgtagcag

SEQ ID NO: 17512 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (3)..(3): base is a locked nucleic acid
  modified_base (9)..(9): base is a locked nucleic acid
  modified_base (10)..(10): base is a locked nucleic acid
aaarthatytrgtagcag

SEQ ID NO: 17513 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (2)..(2): base is a locked nucleic acid
  modified_base (9)..(9): base is a locked nucleic acid
  modified_base (10)..(10): base is a locked nucleic acid
aaarthatytrgtagcag

SEQ ID NO: 17514 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (7)..(7): base is a locked nucleic acid
  modified_base (9)..(9): base is a locked nucleic acid
  modified_base (10)..(10): base is a locked nucleic acid
aaarthatytrgtagcag

SEQ ID NO: 17515 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (4)..(4): base is a locked nucleic acid
  modified_base (9)..(9): base is a locked nucleic acid
  modified_base (10)..(10): base is a locked nucleic acid
aaarthatytrgtagcag

SEQ ID NO: 17516 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (9)..(9): base is a locked nucleic acid
  modified_base (10)..(10): base is a locked nucleic acid
  modified_base (14)..(14): base is a locked nucleic acid
aaarthatytrgtagcag

SEQ ID NO: 17517 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (9)..(9): base is a locked nucleic acid
  modified_base (10)..(10): base is a locked nucleic acid
  modified_base (13)..(13): base is a locked nucleic acid
aaarthatytrgtagcag

SEQ ID NO: 17518 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (9)..(9): base is a locked nucleic acid
  modified_base (10)..(10): base is a locked nucleic acid
  modified_base (15)..(15): base is a locked nucleic acid
aaarthatytrgtagcag

SEQ ID NO: 17519 - DNA, 18 bp, Artificial Sequence
  Oligonucleotide probe
  misc_binding (1)..(18): Hybridization probe for the specific detection of mutant HIV-1 at codon 74 of the integrase gene.
  modified_base (9)..(9): base is a locked nucleic acid
  modified_base (10)..(10): base is a locked nucleic acid
  modified_base (12)..(12): base is a locked nucleic acid
aaarthatytrgtagcag

SEQ ID NO: 17520 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (8)..(8): base is a locked nucleic acid
  modified_base (9)..(9): base is a locked nucleic acid
aarthatytrgtagcag

SEQ ID NO: 17521 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (3)..(3): base is a locked nucleic acid
aarthatytrgtagcag

SEQ ID NO: 17522 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (1)..(1): base is a locked nucleic acid
aarthatytrgtagcag

SEQ ID NO: 17523 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (2)..(2): base is a locked nucleic acid
aarthatytrgtagcag

SEQ ID NO: 17524 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (6)..(6): base is a locked nucleic acid
aarthatytrgtagcag

SEQ ID NO: 17525 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (11)..(11): base is a locked nucleic acid
aarthatytrgtagcag

SEQ ID NO: 17526 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (16)..(16): base is a locked nucleic acid
aarthatytrgtagcag

SEQ ID NO: 17527 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (15)..(15): base is a locked nucleic acid
aarthatytrgtagcag

SEQ ID NO: 17528 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (17)..(17): base is a locked nucleic acid
aarthatytrgtagcag

SEQ ID NO: 17529 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (2)..(2): base is a locked nucleic acid
  modified_base (8)..(8): base is a locked nucleic acid
  modified_base (9)..(9): base is a locked nucleic acid
aarthatytrgtagcag

SEQ ID NO: 17530 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (1)..(1): base is a locked nucleic acid
  modified_base (8)..(8): base is a locked nucleic acid
  modified_base (9)..(9): base is a locked nucleic acid
aarthatytrgtagcag

SEQ ID NO: 17531 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (6)..(6): base is a locked nucleic acid
  modified_base (8)..(8): base is a locked nucleic acid
  modified_base (9)..(9): base is a locked nucleic acid
aarthatytrgtagcag

SEQ ID NO: 17532 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (3)..(3): base is a locked nucleic acid
  modified_base (8)..(8): base is a locked nucleic acid
  modified_base (9)..(9): base is a locked nucleic acid
aarthatytrgtagcag

SEQ ID NO: 17533 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (13)..(13): base is a locked nucleic acid
aarthatytrgtagcag

SEQ ID NO: 17534 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (12)..(12): base is a locked nucleic acid
aarthatytrgtagcag

SEQ ID NO: 17535 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (14)..(14): base is a locked nucleic acid
aarthatytrgtagcag

SEQ ID NO: 17536 - DNA, 17 bp, Artificial Sequence
  Oligonucleotide probe
  misc_binding (1)..(17): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (11)..(11): base is a locked nucleic acid
aarthatytrgtagcag

SEQ ID NO: 17537 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (8)..(8): base is a locked nucleic acid
  modified_base (9)..(9): base is a locked nucleic acid
aarthatytrgtagc

SEQ ID NO: 17538 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (3)..(3): base is a locked nucleic acid
aarthatytrgtagc

SEQ ID NO: 17539 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (1)..(1): base is a locked nucleic acid
aarthatytrgtagc

SEQ ID NO: 17540 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (2)..(2): base is a locked nucleic acid
aarthatytrgtagc

SEQ ID NO: 17541 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (6)..(6): base is a locked nucleic acid
aarthatytrgtagc

SEQ ID NO: 17542 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (11)..(11): base is a locked nucleic acid
aarthatytrgtagc

SEQ ID NO: 17543 - DNA, 15 bp, Artificial Sequence
  Oligonucleotide probe
  misc_binding (1)..(15): Hybridization probe for the specific detection of mutant HIV-1 at codon 74 of the integrase gene.
aarthatytrgtagc

SEQ ID NO: 17544 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (15)..(15): base is a locked nucleic acid
aarthatytrgtagc

SEQ ID NO: 17545 - DNA, 16 bp, Artificial Sequence
  Oligonucleotide probe
  misc_binding (1)..(16): Hybridization probe for the specific detection of mutant HIV-1 at codon 74 of the integrase gene.
aarthatytrgtagca

SEQ ID NO: 17546 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (2)..(2): base is a locked nucleic acid
  modified_base (8)..(8): base is a locked nucleic acid
  modified_base (9)..(9): base is a locked nucleic acid
aarthatytrgtagc

SEQ ID NO: 17547 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (1)..(1): base is a locked nucleic acid
  modified_base (8)..(8): base is a locked nucleic acid
  modified_base (9)..(9): base is a locked nucleic acid
aarthatytrgtagc

SEQ ID NO: 17548 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (6)..(6): base is a locked nucleic acid
  modified_base (8)..(8): base is a locked nucleic acid
  modified_base (9)..(9): base is a locked nucleic acid
aarthatytrgtagc

SEQ ID NO: 17549 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (3)..(3): base is a locked nucleic acid
  modified_base (8)..(8): base is a locked nucleic acid
  modified_base (9)..(9): base is a locked nucleic acid
aarthatytrgtagc

SEQ ID NO: 17550 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (13)..(13): base is a locked nucleic acid
aarthatytrgtagc

SEQ ID NO: 17551 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (12)..(12): base is a locked nucleic acid
aarthatytrgtagc

SEQ ID NO: 17552 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (14)..(14): base is a locked nucleic acid
aarthatytrgtagc

SEQ ID NO: 17553 - DNA, 15 bp, Artificial Sequence
  Oligonucleotide probe
  misc_binding (1)..(15): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (11)..(11): base is a locked nucleic acid
aarthatytrgtagc

SEQ ID NO: 17554 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (8)..(8): base is a locked nucleic acid
  modified_base (9)..(9): base is a locked nucleic acid
aarthatytrgta

SEQ ID NO: 17555 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (3)..(3): base is a locked nucleic acid
aarthatytrgta

SEQ ID NO: 17556 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (1)..(1): base is a locked nucleic acid
aarthatytrgta

SEQ ID NO: 17557 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (2)..(2): base is a locked nucleic acid
aarthatytrgta

SEQ ID NO: 17558 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (6)..(6): base is a locked nucleic acid
aarthatytrgta

SEQ ID NO: 17559 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (11)..(11): base is a locked nucleic acid
aarthatytrgta

SEQ ID NO: 17560 - DNA, 14 bp, Artificial Sequence
  Oligonucleotide probe
  misc_binding (1)..(14): Hybridization probe for the specific detection of mutant HIV-1 at codon 74 of the integrase gene.
aarthatytrgtag

SEQ ID NO: 17561 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (2)..(2): base is a locked nucleic acid
  modified_base (8)..(8): base is a locked nucleic acid
  modified_base (9)..(9): base is a locked nucleic acid
aarthatytrgta

SEQ ID NO: 17562 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (1)..(1): base is a locked nucleic acid
  modified_base (8)..(8): base is a locked nucleic acid
  modified_base (9)..(9): base is a locked nucleic acid
aarthatytrgta

SEQ ID NO: 17563 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (6)..(6): base is a locked nucleic acid
  modified_base (8)..(8): base is a locked nucleic acid
  modified_base (9)..(9): base is a locked nucleic acid
aarthatytrgta

SEQ ID NO: 17564 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (3)..(3): base is a locked nucleic acid
  modified_base (8)..(8): base is a locked nucleic acid
  modified_base (9)..(9): base is a locked nucleic acid
aarthatytrgta

SEQ ID NO: 17565 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (13)..(13): base is a locked nucleic acid
aarthatytrgta

SEQ ID NO: 17566 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (12)..(12): base is a locked nucleic acid
aarthatytrgta

SEQ ID NO: 17567 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (8)..(8): base is a locked nucleic acid
  modified_base (9)..(9): base is a locked nucleic acid
aarthatytrgta

SEQ ID NO: 17568 - DNA, 13 bp, Artificial Sequence
  Oligonucleotide probe
  misc_binding (1)..(13): Hybridization probe for the specific detection of mutant HIV-1 at codon 74 of the integrase gene.
  modified_base (8)..(8): base is a locked nucleic acid
  modified_base (9)..(9): base is a locked nucleic acid
  modified_base (11)..(11): base is a locked nucleic acid
aarthatytrgta

SEQ ID NO: 17569 - DNA, 18 bp, Artificial Sequence
  Oligonucleotide probe
  misc_binding (1)..(18): Hybridization probe for the specific detection of mutant HIV-1 at codon 74 of the integrase gene.
aaarthatytrgtagcag

SEQ ID NO: 17570 - DNA, 17 bp, Artificial Sequence
  Oligonucleotide probe
  misc_binding (1)..(17): Hybridization probe for the specific detection of mutant HIV-1 at codon 74 of the integrase gene.
aarthatytrgtagcag

SEQ ID NO: 17571 - DNA, 15 bp, Artificial Sequence
  Oligonucleotide probe
  misc_binding (1)..(15): Hybridization probe for the specific detection of mutant HIV-1 at codon 74 of the integrase gene.
aarthatytrgtagc

SEQ ID NO: 17572 - DNA, 13 bp, Artificial Sequence
  Oligonucleotide probe
  misc_binding (1)..(13): Hybridization probe for the specific detection of mutant HIV-1 at codon 74 of the integrase gene.
aarthatytrgta

SEQ ID NO: 17573 - DNA, 15 bp, Artificial Sequence
  Oligonucleotide probe
  misc_binding (1)..(15): Hybridization probe for the specific detection of mutant HIV-1 at codon 74 of the integrase gene.
aattatcatggtagc

SEQ ID NO: 17574 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
tyccagcagracaggrca

SEQ ID NO: 17575 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (6)..(6): base is a locked nucleic acid
tyccagcagracaggrca

SEQ ID NO: 17576 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
tyccagcagracaggrca

SEQ ID NO: 17577 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (7)..(7): base is a locked nucleic acid
tyccagcagracaggrca

SEQ ID NO: 17578 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (8)..(8): base is a locked nucleic acid
tyccagcagracaggrca

SEQ ID NO: 17579 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (10)..(10): base is a locked nucleic acid
tyccagcagracaggrca

SEQ ID NO: 17580 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (14)..(14): base is a locked nucleic acid
tyccagcagracaggrca

SEQ ID NO: 17581 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (16)..(16): base is a locked nucleic acid
tyccagcagracaggrca

SEQ ID NO: 17582 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (12)..(12): base is a locked nucleic acid
tyccagcagracaggrca

SEQ ID NO: 17583 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (6)..(6): base is a locked nucleic acid
  modified_base (9)..(9): base is a locked nucleic acid
  modified_base (10)..(10): base is a locked nucleic acid
tyccagcagracaggrca

SEQ ID NO: 17584 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (5)..(5): base is a locked nucleic acid
  modified_base (9)..(9): base is a locked nucleic acid
  modified_base (10)..(10): base is a locked nucleic acid
tyccagcagracaggrca

SEQ ID NO: 17585 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (4)..(4): base is a locked nucleic acid
  modified_base (9)..(9): base is a locked nucleic acid
  modified_base (10)..(10): base is a locked nucleic acid
tyccagcagracaggrca

SEQ ID NO: 17586 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (3)..(3): base is a locked nucleic acid
  modified_base (9)..(9): base is a locked nucleic acid
  modified_base (10)..(10): base is a locked nucleic acid
tyccagcagracaggrca

SEQ ID NO: 17587 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (13)..(13): base is a locked nucleic acid
tyccagcagracaggrca

SEQ ID NO: 17588 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (18)..(18): base is a locked nucleic acid
tyccagcagracaggrca

SEQ ID NO: 17589 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (12)..(12): base is a locked nucleic acid
tyccagcagracaggrca

SEQ ID NO: 17590 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (11)..(11): base is a locked nucleic acid
tyccagcagracaggrca

SEQ ID NO: 17591 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
atyccagcaaracaggrc

SEQ ID NO: 17592 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (7)..(7): base is a locked nucleic acid
atyccagcaaracaggrc

SEQ ID NO: 17593 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (3)..(3): base is a locked nucleic acid
atyccagcaaracaggrc

SEQ ID NO: 17594 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (8)..(8): base is a locked nucleic acid
atyccagcaaracaggrc

SEQ ID NO: 17595 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (4)..(4): base is a locked nucleic acid
atyccagcaaracaggrc

SEQ ID NO: 17596 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (10)..(10): base is a locked nucleic acid
atyccagcaaracaggrc

SEQ ID NO: 17597 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (13)..(13): base is a locked nucleic acid
atyccagcaaracaggrc

SEQ ID NO: 17598 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (16)..(16): base is a locked nucleic acid
atyccagcaaracaggrc

SEQ ID NO: 17599 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (11)..(11): base is a locked nucleic acid
atyccagcaaracaggrc

SEQ ID NO: 17600 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (7)..(7): base is a locked nucleic acid
  modified_base (9)..(9): base is a locked nucleic acid
  modified_base (10)..(10): base is a locked nucleic acid
atyccagcaaracaggrc

SEQ ID NO: 17601 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (4)..(4): base is a locked nucleic acid
  modified_base (9)..(9): base is a locked nucleic acid
  modified_base (10)..(10): base is a locked nucleic acid
atyccagcaaracaggrc

SEQ ID NO: 17602 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (3)..(3): base is a locked nucleic acid
  modified_base (9)..(9): base is a locked nucleic acid
  modified_base (10)..(10): base is a locked nucleic acid
atyccagcaaracaggrc

SEQ ID NO: 17603 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (5)..(5): base is a locked nucleic acid
  modified_base (9)..(9): base is a locked nucleic acid
  modified_base (10)..(10): base is a locked nucleic acid
atyccagcaaracaggrc

SEQ ID NO: 17604 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (16)..(16): base is a locked nucleic acid
atyccagcaaracaggrc

SEQ ID NO: 17605 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (15)..(15): base is a locked nucleic acid
atyccagcaaracaggrc

SEQ ID NO: 17606 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (13)..(13): base is a locked nucleic acid
atyccagcaaracaggrc

SEQ ID NO: 17607 - DNA, 18 bp, Artificial Sequence
  Oligonucleotide probe
  misc_binding (1)..(18): Hybridization probe for the specific detection of mutant HIV-1 at codon 92 of the integrase gene.
  modified_base (9)..(9): base is a locked nucleic acid
  modified_base (10)..(10): base is a locked nucleic acid
  modified_base (11)..(11): base is a locked nucleic acid
atyccagcaaracaggrc

SEQ ID NO: 17608 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
yccagcagracaggrca

SEQ ID NO: 17609 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (5)..(5): base is a locked nucleic acid
yccagcagracaggrca

SEQ ID NO: 17610 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
yccagcagracaggrca

SEQ ID NO: 17611 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (6)..(6): base is a locked nucleic acid
yccagcagracaggrca

SEQ ID NO: 17612 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (7)..(7): base is a locked nucleic acid
yccagcagracaggrca

SEQ ID NO: 17613 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (9)..(9): base is a locked nucleic acid
yccagcagracaggrca

SEQ ID NO: 17614 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (13)..(13): base is a locked nucleic acid
yccagcagracaggrca

SEQ ID NO: 17615 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (15)..(15): base is a locked nucleic acid
yccagcagracaggrca

SEQ ID NO: 17616 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (11)..(11): base is a locked nucleic acid
yccagcagracaggrca

SEQ ID NO: 17617 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (5)..(5): base is a locked nucleic acid
  modified_base (8)..(8): base is a locked nucleic acid
  modified_base (9)..(9): base is a locked nucleic acid
yccagcagracaggrca

SEQ ID NO: 17618 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (4)..(4): base is a locked nucleic acid
  modified_base (8)..(8): base is a locked nucleic acid
  modified_base (9)..(9): base is a locked nucleic acid
yccagcagracaggrca

SEQ ID NO: 17619 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (3)..(3): base is a locked nucleic acid
  modified_base (8)..(8): base is a locked nucleic acid
  modified_base (9)..(9): base is a locked nucleic acid
yccagcagracaggrca

SEQ ID NO: 17620 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (2)..(2): base is a locked nucleic acid
  modified_base (8)..(8): base is a locked nucleic acid
  modified_base (9)..(9): base is a locked nucleic acid
yccagcagracaggrca

SEQ ID NO: 17621 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (12)..(12): base is a locked nucleic acid
yccagcagracaggrca

SEQ ID NO: 17622 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (17)..(17): base is a locked nucleic acid
yccagcagracaggrca

SEQ ID NO: 17623 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (11)..(11): base is a locked nucleic acid
yccagcagracaggrca

SEQ ID NO: 17624 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (10)..(10): base is a locked nucleic acid
yccagcagracaggrca

SEQ ID NO: 17625 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
tyccagcaaracaggrc

SEQ ID NO: 17626 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (6)..(6): base is a locked nucleic acid
tyccagcaaracaggrc

SEQ ID NO: 17627 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (2)..(2): base is a locked nucleic acid
tyccagcaaracaggrc

SEQ ID NO: 17628 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (7)..(7): base is a locked nucleic acid
tyccagcaaracaggrc

SEQ ID NO: 17629 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (3)..(3): base is a locked nucleic acid
tyccagcaaracaggrc

SEQ ID NO: 17630 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (9)..(9): base is a locked nucleic acid
tyccagcaaracaggrc

SEQ ID NO: 17631 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (12)..(12): base is a locked nucleic acid
tyccagcaaracaggrc

SEQ ID NO: 17632 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (15)..(15): base is a locked nucleic acid
tyccagcaaracaggrc

SEQ ID NO: 17633 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (10)..(10): base is a locked nucleic acid
tyccagcaaracaggrc

SEQ ID NO: 17634 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (6)..(6): base is a locked nucleic acid
  modified_base (8)..(8): base is a locked nucleic acid
  modified_base (9)..(9): base is a locked nucleic acid
tyccagcaaracaggrc

SEQ ID NO: 17635 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (3)..(3): base is a locked nucleic acid
  modified_base (8)..(8): base is a locked nucleic acid
  modified_base (9)..(9): base is a locked nucleic acid
tyccagcaaracaggrc

SEQ ID NO: 17636 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (2)..(2): base is a locked nucleic acid
  modified_base (8)..(8): base is a locked nucleic acid
  modified_base (9)..(9): base is a locked nucleic acid
tyccagcaaracaggrc

SEQ ID NO: 17637 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (4)..(4): base is a locked nucleic acid
  modified_base (8)..(8): base is a locked nucleic acid
  modified_base (9)..(9): base is a locked nucleic acid
tyccagcaaracaggrc

SEQ ID NO: 17638 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (15)..(15): base is a locked nucleic acid
tyccagcaaracaggrc

SEQ ID NO: 17639 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (14)..(14): base is a locked nucleic acid
tyccagcaaracaggrc

SEQ ID NO: 17640 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (12)..(12): base is a locked nucleic acid
tyccagcaaracaggrc

SEQ ID NO: 17641 - DNA, 17 bp, Artificial Sequence
  Oligonucleotide probe
  misc_binding (1)..(17): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (10)..(10): base is a locked nucleic acid
tyccagcaaracaggrc

SEQ ID NO: 17642 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
yccagcagracaggr

SEQ ID NO: 17643 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (5)..(5): base is a locked nucleic acid
yccagcagracaggr

SEQ ID NO: 17644 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
yccagcagracaggr

SEQ ID NO: 17645 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (6)..(6): base is a locked nucleic acid
yccagcagracaggr

SEQ ID NO: 17646 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (7)..(7): base is a locked nucleic acid
yccagcagracaggr

SEQ ID NO: 17647 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (9)..(9): base is a locked nucleic acid
yccagcagracaggr

SEQ ID NO: 17648 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (13)..(13): base is a locked nucleic acid
yccagcagracaggr

SEQ ID NO: 17649 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (15)..(15): base is a locked nucleic acid
yccagcagracaggr

SEQ ID NO: 17650 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (11)..(11): base is a locked nucleic acid
yccagcagracaggr

SEQ ID NO: 17651 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (5)..(5): base is a locked nucleic acid
  modified_base (8)..(8): base is a locked nucleic acid
  modified_base (9)..(9): base is a locked nucleic acid
yccagcagracaggr

SEQ ID NO: 17652 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (4)..(4): base is a locked nucleic acid
  modified_base (8)..(8): base is a locked nucleic acid
  modified_base (9)..(9): base is a locked nucleic acid
yccagcagracaggr

SEQ ID NO: 17653 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (3)..(3): base is a locked nucleic acid
  modified_base (8)..(8): base is a locked nucleic acid
  modified_base (9)..(9): base is a locked nucleic acid
yccagcagracaggr

SEQ ID NO: 17654 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (2)..(2): base is a locked nucleic acid
  modified_base (8)..(8): base is a locked nucleic acid
  modified_base (9)..(9): base is a locked nucleic acid
yccagcagracaggr

SEQ ID NO: 17655 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (12)..(12): base is a locked nucleic acid
yccagcagracaggr

SEQ ID NO: 17656 - DNA, 16 bp, Artificial Sequence
  Oligonucleotide probe
  misc_binding (1)..(16): Hybridization probe for the specific detection of mutant HIV-1 at codon 92 of the integrase gene.
  modified_base (8)..(8): base is a locked nucleic acid
  modified_base (9)..(9): base is a locked nucleic acid
yccagcagracaggrc

SEQ ID NO: 17657 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (11)..(11): base is a locked nucleic acid
yccagcagracaggr

SEQ ID NO: 17658 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (10)..(10): base is a locked nucleic acid
yccagcagracaggr

SEQ ID NO: 17659 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
tyccagcaaracagg

SEQ ID NO: 17660 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (6)..(6): base is a locked nucleic acid
tyccagcaaracagg

SEQ ID NO: 17661 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (2)..(2): base is a locked nucleic acid
tyccagcaaracagg

SEQ ID NO: 17662 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (7)..(7): base is a locked nucleic acid
tyccagcaaracagg

SEQ ID NO: 17663 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (3)..(3): base is a locked nucleic acid
tyccagcaaracagg

SEQ ID NO: 17664 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (9)..(9): base is a locked nucleic acid
tyccagcaaracagg

SEQ ID NO: 17665 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (12)..(12): base is a locked nucleic acid
tyccagcaaracagg

SEQ ID NO: 17666 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (15)..(15): base is a locked nucleic acid
tyccagcaaracagg

SEQ ID NO: 17667 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (10)..(10): base is a locked nucleic acid
tyccagcaaracagg

SEQ ID NO: 17668 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (6)..(6): base is a locked nucleic acid
  modified_base (8)..(8): base is a locked nucleic acid
  modified_base (9)..(9): base is a locked nucleic acid
tyccagcaaracagg

SEQ ID NO: 17669 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (3)..(3): base is a locked nucleic acid
  modified_base (8)..(8): base is a locked nucleic acid
  modified_base (9)..(9): base is a locked nucleic acid
tyccagcaaracagg

SEQ ID NO: 17670 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (2)..(2): base is a locked nucleic acid
  modified_base (8)..(8): base is a locked nucleic acid
  modified_base (9)..(9): base is a locked nucleic acid
tyccagcaaracagg

SEQ ID NO: 17671 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (4)..(4): base is a locked nucleic acid
  modified_base (8)..(8): base is a locked nucleic acid
  modified_base (9)..(9): base is a locked nucleic acid
tyccagcaaracagg

SEQ ID NO: 17672 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (15)..(15): base is a locked nucleic acid
tyccagcaaracagg

SEQ ID NO: 17673 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (14)..(14): base is a locked nucleic acid
tyccagcaaracagg

SEQ ID NO: 17674 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (12)..(12): base is a locked nucleic acid
tyccagcaaracagg

SEQ ID NO: 17675 - DNA, 15 bp, Artificial Sequence
  Oligonucleotide probe
  misc_binding (1)..(15): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (10)..(10): base is a locked nucleic acid
tyccagcaaracagg

SEQ ID NO: 17676 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
yccagcagracag

SEQ ID NO: 17677 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (5)..(5): base is a locked nucleic acid
yccagcagracag

SEQ ID NO: 17678 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
yccagcagracag

SEQ ID NO: 17679 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (6)..(6): base is a locked nucleic acid
yccagcagracag

SEQ ID NO: 17680 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (7)..(7): base is a locked nucleic acid
yccagcagracag

SEQ ID NO: 17681 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (9)..(9): base is a locked nucleic acid
yccagcagracag

SEQ ID NO: 17682 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (13)..(13): base is a locked nucleic acid
yccagcagracag

SEQ ID NO: 17683 - DNA, 14 bp, Artificial Sequence
  Oligonucleotide probe
  misc_binding (1)..(14): Hybridization probe for the specific detection of mutant HIV-1 at codon 92 of the integrase gene.
yccagcagracagg

SEQ ID NO: 17684 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (11)..(11): base is a locked nucleic acid
yccagcagracag

SEQ ID NO: 17685 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (5)..(5): base is a locked nucleic acid
  modified_base (8)..(8): base is a locked nucleic acid
  modified_base (9)..(9): base is a locked nucleic acid
yccagcagracag

SEQ ID NO: 17686 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (4)..(4): base is a locked nucleic acid
  modified_base (8)..(8): base is a locked nucleic acid
  modified_base (9)..(9): base is a locked nucleic acid
yccagcagracag

SEQ ID NO: 17687 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (3)..(3): base is a locked nucleic acid
  modified_base (8)..(8): base is a locked nucleic acid
  modified_base (9)..(9): base is a locked nucleic acid
yccagcagracag

SEQ ID NO: 17688 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (2)..(2): base is a locked nucleic acid
  modified_base (8)..(8): base is a locked nucleic acid
  modified_base (9)..(9): base is a locked nucleic acid
yccagcagracag

SEQ ID NO: 17689 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (12)..(12): base is a locked nucleic acid
yccagcagracag

SEQ ID NO: 17690 - DNA, 14 bp, Artificial Sequence
  Oligonucleotide probe
  misc_binding (1)..(14): Hybridization probe for the specific detection of mutant HIV-1 at codon 92 of the integrase gene.
  modified_base (8)..(8): base is a locked nucleic acid
  modified_base (9)..(9): base is a locked nucleic acid
yccagcagracagg

SEQ ID NO: 17691 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (11)..(11): base is a locked nucleic acid
yccagcagracag

SEQ ID NO: 17692 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (10)..(10): base is a locked nucleic acid
yccagcagracag

SEQ ID NO: 17693 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
tyccagcaaraca

SEQ ID NO: 17694 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (6)..(6): base is a locked nucleic acid
tyccagcaaraca

SEQ ID NO: 17695 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (2)..(2): base is a locked nucleic acid
tyccagcaaraca

SEQ ID NO: 17696 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (7)..(7): base is a locked nucleic acid
tyccagcaaraca

SEQ ID NO: 17697 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (3)..(3): base is a locked nucleic acid
tyccagcaaraca

SEQ ID NO: 17698 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (9)..(9): base is a locked nucleic acid
tyccagcaaraca

SEQ ID NO: 17699 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (12)..(12): base is a locked nucleic acid
tyccagcaaraca

SEQ ID NO: 17700 - DNA, 14 bp, Artificial Sequence
  Oligonucleotide probe
  misc_binding (1)..(14): Hybridization probe for the specific detection of mutant HIV-1 at codon 92 of the integrase gene.
tyccagcaaracag

SEQ ID NO: 17701 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (10)..(10): base is a locked nucleic acid
tyccagcaaraca

SEQ ID NO: 17702 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (6)..(6): base is a locked nucleic acid
  modified_base (8)..(8): base is a locked nucleic acid
  modified_base (9)..(9): base is a locked nucleic acid
tyccagcaaraca

SEQ ID NO: 17703 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (3)..(3): base is a locked nucleic acid
  modified_base (8)..(8): base is a locked nucleic acid
  modified_base (9)..(9): base is a locked nucleic acid
tyccagcaaraca

SEQ ID NO: 17704 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (2)..(2): base is a locked nucleic acid
  modified_base (8)..(8): base is a locked nucleic acid
  modified_base (9)..(9): base is a locked nucleic acid
tyccagcaaraca

SEQ ID NO: 17705 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (4)..(4): base is a locked nucleic acid
  modified_base (8)..(8): base is a locked nucleic acid
  modified_base (9)..(9): base is a locked nucleic acid
tyccagcaaraca

SEQ ID NO: 17706 - DNA, 14 bp, Artificial Sequence
  Oligonucleotide probe
  misc_binding (1)..(14): Hybridization probe for the specific detection of mutant HIV-1 at codon 92 of the integrase gene.
  modified_base (8)..(8): base is a locked nucleic acid
  modified_base (9)..(9): base is a locked nucleic acid
tyccagcaaracag

SEQ ID NO: 17707 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
tyccagcaaraca

SEQ ID NO: 17708 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (12)..(12): base is a locked nucleic acid
tyccagcaaraca

SEQ ID NO: 17709 - DNA, 13 bp, Artificial Sequence
  Oligonucleotide probe
  misc_binding (1)..(13): Hybridization probe for the specific detection of mutant HIV-1 at codon 92 of the integrase gene.
  modified_base (8)..(8): base is a locked nucleic acid
  modified_base (9)..(9): base is a locked nucleic acid
  modified_base (10)..(10): base is a locked nucleic acid
tyccagcaaraca

SEQ ID NO: 17710 - DNA, 18 bp, Artificial Sequence
  Oligonucleotide probe
  misc_binding (1)..(18): Hybridization probe for the specific detection of mutant HIV-1 at codon 92 of the integrase gene.
tyccagcagracaggrca

SEQ ID NO: 17711 - DNA, 18 bp, Artificial Sequence
  Oligonucleotide probe
  misc_binding (1)..(18): Hybridization probe for the specific detection of mutant HIV-1 at codon 92 of the integrase gene.
atyccagcaaracaggrc

SEQ ID NO: 17712 - DNA, 17 bp, Artificial Sequence
  Oligonucleotide probe
  misc_binding (1)..(17): Hybridization probe for the specific detection of mutant HIV-1 at codon 92 of the integrase gene.
yccagcagracaggrca

SEQ ID NO: 17713 - DNA, 17 bp, Artificial Sequence
  Oligonucleotide probe
  misc_binding (1)..(17): Hybridization probe for the specific detection of mutant HIV-1 at codon 92 of the integrase gene.
tyccagcaaracaggrc

SEQ ID NO: 17714 - DNA, 15 bp, Artificial Sequence
  Oligonucleotide probe
  misc_binding (1)..(15): Hybridization probe for the specific detection of mutant HIV-1 at codon 92 of the integrase gene.
yccagcagracaggr

SEQ ID NO: 17715 - DNA, 16 bp, Artificial Sequence
  Oligonucleotide probe
  misc_binding (1)..(16): Hybridization probe for the specific detection of mutant HIV-1 at codon 92 of the integrase gene.
yccagcagracaggrc

SEQ ID NO: 17716 - DNA, 15 bp, Artificial Sequence
  Oligonucleotide probe
  misc_binding (1)..(15): Hybridization probe for the specific detection of mutant HIV-1 at codon 92 of the integrase gene.
tyccagcaaracagg

SEQ ID NO: 17717 - DNA, 13 bp, Artificial Sequence
  Oligonucleotide probe
  misc_binding (1)..(13): Hybridization probe for the specific detection of mutant HIV-1 at codon 92 of the integrase gene.
yccagcagracag

SEQ ID NO: 17718 - DNA, 13 bp, Artificial Sequence
  Oligonucleotide probe
  misc_binding (1)..(13): Hybridization probe for the specific detection of mutant HIV-1 at codon 92 of the integrase gene.
tyccagcaaraca

SEQ ID NO: 17719 - DNA, 15 bp, Artificial Sequence
  Oligonucleotide probe
  misc_binding (1)..(15): Hybridization probe for the specific detection of mutant HIV-1 at codon 92 of the integrase gene.
cccagcacaracagg

SEQ ID NO: 17720 - DNA, 15 bp, Artificial Sequence
  Oligonucleotide probe
  misc_binding (1)..(15): Hybridization probe for the specific detection of mutant HIV-1 at codon 92 of the integrase gene.
cccagcaggracagg

SEQ ID NO: 17721 - DNA, 15 bp, Artificial Sequence
  Oligonucleotide probe
  misc_binding (1)..(15): Hybridization probe for the specific detection of mutant HIV-1 at codon 92 of the integrase gene.
cccagcagtracagg

SEQ ID NO: 17722 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (9)..(9): base is a locked nucleic acid
  modified_base (10)..(10): base is a locked nucleic acid
ggrcargarcagcatayt

SEQ ID NO: 17723 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (3)..(3): base is a locked nucleic acid
ggrcargarcagcatayt

SEQ ID NO: 17724 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (8)..(8): base is a locked nucleic acid
ggrcargarcagcatayt

SEQ ID NO: 17725 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (2)..(2): base is a locked nucleic acid
ggrcargarcagcatayt

SEQ ID NO: 17726 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (9)..(9): base is a locked nucleic acid
ggrcargarcagcatayt

SEQ ID NO: 17727 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (13)..(13): base is a locked nucleic acid
ggrcargarcagcatayt

SEQ ID NO: 17728 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (18)..(18): base is a locked nucleic acid
ggrcargarcagcatayt

SEQ ID NO: 17729 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (11)..(11): base is a locked nucleic acid
ggrcargarcagcatayt

SEQ ID NO: 17730 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (12)..(12): base is a locked nucleic acid
ggrcargarcagcatayt

SEQ ID NO: 17731 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (3)..(3): base is a locked nucleic acid
  modified_base (9)..(9): base is a locked nucleic acid
  modified_base (10)..(10): base is a locked nucleic acid
ggrcargarcagcatayt

SEQ ID NO: 17732 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (5)..(5): base is a locked nucleic acid
  modified_base (9)..(9): base is a locked nucleic acid
  modified_base (10)..(10): base is a locked nucleic acid
ggrcargarcagcatayt

SEQ ID NO: 17733 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (4)..(4): base is a locked nucleic acid
  modified_base (9)..(9): base is a locked nucleic acid
  modified_base (10)..(10): base is a locked nucleic acid
ggrcargarcagcatayt

SEQ ID NO: 17734 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (2)..(2): base is a locked nucleic acid
  modified_base (9)..(9): base is a locked nucleic acid
  modified_base (10)..(10): base is a locked nucleic acid
ggrcargarcagcatayt

SEQ ID NO: 17735 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (9)..(9): base is a locked nucleic acid
  modified_base (10)..(10): base is a locked nucleic acid
  modified_base (18)..(18): base is a locked nucleic acid
ggrcargarcagcatayt

SEQ ID NO: 17736 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (9)..(9): base is a locked nucleic acid
  modified_base (10)..(10): base is a locked nucleic acid
  modified_base (15)..(15): base is a locked nucleic acid
ggrcargarcagcatayt

SEQ ID NO: 17737 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (9)..(9): base is a locked nucleic acid
  modified_base (10)..(10): base is a locked nucleic acid
  modified_base (14)..(14): base is a locked nucleic acid
ggrcargarcagcatayt

SEQ ID NO: 17738 - DNA, 18 bp, Artificial Sequence
  Oligonucleotide probe
  misc_binding (1)..(18): Hybridization probe for the specific detection of mutant HIV-1 at codon 97 of the integrase gene.
  modified_base (9)..(9): base is a locked nucleic acid
  modified_base (10)..(10): base is a locked nucleic acid
  modified_base (12)..(12): base is a locked nucleic acid
ggrcargarcagcatayt

SEQ ID NO: 17739 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (8)..(8): base is a locked nucleic acid
  modified_base (9)..(9): base is a locked nucleic acid
grcargarcagcatayt

SEQ ID NO: 17740 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (2)..(2): base is a locked nucleic acid
grcargarcagcatayt

SEQ ID NO: 17741 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (7)..(7): base is a locked nucleic acid
grcargarcagcatayt

SEQ ID NO: 17742 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (1)..(1): base is a locked nucleic acid
grcargarcagcatayt

SEQ ID NO: 17743 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (8)..(8): base is a locked nucleic acid
grcargarcagcatayt

SEQ ID NO: 17744 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (12)..(12): base is a locked nucleic acid
grcargarcagcatayt

SEQ ID NO: 17745 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (17)..(17): base is a locked nucleic acid
grcargarcagcatayt

SEQ ID NO: 17746 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (10)..(10): base is a locked nucleic acid
grcargarcagcatayt

SEQ ID NO: 17747 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (11)..(11): base is a locked nucleic acid
grcargarcagcatayt

SEQ ID NO: 17748 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (2)..(2): base is a locked nucleic acid
  modified_base (8)..(8): base is a locked nucleic acid
  modified_base (9)..(9): base is a locked nucleic acid
grcargarcagcatayt

SEQ ID NO: 17749 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (4)..(4): base is a locked nucleic acid
  modified_base (8)..(8): base is a locked nucleic acid
  modified_base (9)..(9): base is a locked nucleic acid
grcargarcagcatayt

SEQ ID NO: 17750 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (3)..(3): base is a locked nucleic acid
  modified_base (8)..(8): base is a locked nucleic acid
  modified_base (9)..(9): base is a locked nucleic acid
grcargarcagcatayt

SEQ ID NO: 17751 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (1)..(1): base is a locked nucleic acid
  modified_base (8)..(8): base is a locked nucleic acid
  modified_base (9)..(9): base is a locked nucleic acid
grcargarcagcatayt

SEQ ID NO: 17752 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (17)..(17): base is a locked nucleic acid
grcargarcagcatayt

SEQ ID NO: 17753 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (14)..(14): base is a locked nucleic acid
grcargarcagcatayt

SEQ ID NO: 17754 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (13)..(13): base is a locked nucleic acid
grcargarcagcatayt

SEQ ID NO: 17755 - DNA, 17 bp, Artificial Sequence
  Oligonucleotide probe
  misc_binding (1)..(17): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (11)..(11): base is a locked nucleic acid
grcargarcagcatayt

SEQ ID NO: 17756 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (8)..(8): base is a locked nucleic acid
  modified_base (9)..(9): base is a locked nucleic acid
grcargarcagcata

SEQ ID NO: 17757 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (2)..(2): base is a locked nucleic acid
grcargarcagcata

SEQ ID NO: 17758 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (7)..(7): base is a locked nucleic acid
grcargarcagcata

SEQ ID NO: 17759 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (1)..(1): base is a locked nucleic acid
grcargarcagcata

SEQ ID NO: 17760 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (8)..(8): base is a locked nucleic acid
grcargarcagcata

SEQ ID NO: 17761 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (12)..(12): base is a locked nucleic acid
grcargarcagcata

SEQ ID NO: 17762 - DNA, 16 bp, Artificial Sequence
  Oligonucleotide probe
  misc_binding (1)..(16): Hybridization probe for the specific detection of mutant HIV-1 at codon 97 of the integrase gene.
grcargarcagcatay

SEQ ID NO: 17763 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (10)..(10): base is a locked nucleic acid
grcargarcagcata

SEQ ID NO: 17764 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (11)..(11): base is a locked nucleic acid
grcargarcagcata

SEQ ID NO: 17765 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (2)..(2): base is a locked nucleic acid
  modified_base (8)..(8): base is a locked nucleic acid
  modified_base (9)..(9): base is a locked nucleic acid
grcargarcagcata

SEQ ID NO: 17766 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (4)..(4): base is a locked nucleic acid
  modified_base (8)..(8): base is a locked nucleic acid
  modified_base (9)..(9): base is a locked nucleic acid
grcargarcagcata

SEQ ID NO: 17767 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (3)..(3): base is a locked nucleic acid
  modified_base (8)..(8): base is a locked nucleic acid
  modified_base (9)..(9): base is a locked nucleic acid
grcargarcagcata

SEQ ID NO: 17768 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (1)..(1): base is a locked nucleic acid
  modified_base (8)..(8): base is a locked nucleic acid
  modified_base (9)..(9): base is a locked nucleic acid
grcargarcagcata

SEQ ID NO: 17769 - DNA, 16 bp, Artificial Sequence
  Oligonucleotide probe
  misc_binding (1)..(16): Hybridization probe for the specific detection of mutant HIV-1 at codon 97 of the integrase gene.
  modified_base (8)..(8): base is a locked nucleic acid
  modified_base (9)..(9): base is a locked nucleic acid
grcargarcagcatay

SEQ ID NO: 17770 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (14)..(14): base is a locked nucleic acid
grcargarcagcata

SEQ ID NO: 17771 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (13)..(13): base is a locked nucleic acid
grcargarcagcata

SEQ ID NO: 17772 - DNA, 15 bp, Artificial Sequence
  Oligonucleotide probe
  misc_binding (1)..(15): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (11)..(11): base is a locked nucleic acid
grcargarcagcata

SEQ ID NO: 17773 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (8)..(8): base is a locked nucleic acid
  modified_base (9)..(9): base is a locked nucleic acid
grcargarcagca

SEQ ID NO: 17774 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (2)..(2): base is a locked nucleic acid
grcargarcagca

SEQ ID NO: 17775 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (7)..(7): base is a locked nucleic acid
grcargarcagca

SEQ ID NO: 17776 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (1)..(1): base is a locked nucleic acid
grcargarcagca

SEQ ID NO: 17777 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (8)..(8): base is a locked nucleic acid
grcargarcagca

SEQ ID NO: 17778 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (12)..(12): base is a locked nucleic acid
grcargarcagca

SEQ ID NO: 17779 - DNA, 14 bp, Artificial Sequence
  Oligonucleotide probe
  misc_binding (1)..(14): Hybridization probe for the specific detection of mutant HIV-1 at codon 97 of the integrase gene.
grcargarcagcat

SEQ ID NO: 17780 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (10)..(10): base is a locked nucleic acid
grcargarcagca

SEQ ID NO: 17781 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (11)..(11): base is a locked nucleic acid
grcargarcagca

SEQ ID NO: 17782 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (2)..(2): base is a locked nucleic acid
  modified_base (8)..(8): base is a locked nucleic acid
  modified_base (9)..(9): base is a locked nucleic acid
grcargarcagca

SEQ ID NO: 17783 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (4)..(4): base is a locked nucleic acid
  modified_base (8)..(8): base is a locked nucleic acid
  modified_base (9)..(9): base is a locked nucleic acid
grcargarcagca

SEQ ID NO: 17784 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (3)..(3): base is a locked nucleic acid
  modified_base (8)..(8): base is a locked nucleic acid
  modified_base (9)..(9): base is a locked nucleic acid
grcargarcagca

SEQ ID NO: 17785 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (1)..(1): base is a locked nucleic acid
  modified_base (8)..(8): base is a locked nucleic acid
  modified_base (9)..(9): base is a locked nucleic acid
grcargarcagca

SEQ ID NO: 17786 - DNA, 14 bp, Artificial Sequence
  Oligonucleotide probe
  misc_binding (1)..(14): Hybridization probe for the specific detection of mutant HIV-1 at codon 97 of the integrase gene.
  modified_base (8)..(8): base is a locked nucleic acid
  modified_base (9)..(9): base is a locked nucleic acid
grcargarcagcat

SEQ ID NO: 17787 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (8)..(8): base is a locked nucleic acid
  modified_base (9)..(9): base is a locked nucleic acid
grcargarcagca

SEQ ID NO: 17788 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (13)..(13): base is a locked nucleic acid
grcargarcagca

SEQ ID NO: 17789 - DNA, 13 bp, Artificial Sequence
  Oligonucleotide probe
  misc_binding (1)..(13): Hybridization probe for the specific detection of mutant HIV-1 at codon 97 of the integrase gene.
  modified_base (8)..(8): base is a locked nucleic acid
  modified_base (9)..(9): base is a locked nucleic acid
  modified_base (11)..(11): base is a locked nucleic acid
grcargarcagca

SEQ ID NO: 17790 - DNA, 18 bp, Artificial Sequence
  Oligonucleotide probe
  misc_binding (1)..(18): Hybridization probe for the specific detection of mutant HIV-1 at codon 97 of the integrase gene.
ggrcargarcagcatayt

SEQ ID NO: 17791 - DNA, 17 bp, Artificial Sequence
  Oligonucleotide probe
  misc_binding (1)..(17): Hybridization probe for the specific detection of mutant HIV-1 at codon 97 of the integrase gene.
grcargarcagcatayt

SEQ ID NO: 17792 - DNA, 15 bp, Artificial Sequence
  Oligonucleotide probe
  misc_binding (1)..(15): Hybridization probe for the specific detection of mutant HIV-1 at codon 97 of the integrase gene.
grcargarcagcata

SEQ ID NO: 17793 - DNA, 13 bp, Artificial Sequence
  Oligonucleotide probe
  misc_binding (1)..(13): Hybridization probe for the specific detection of mutant HIV-1 at codon 97 of the integrase gene.
grcargarcagca

SEQ ID NO: 17794 - DNA, 15 bp, Artificial Sequence
  Oligonucleotide probe
  misc_binding (1)..(15): Hybridization probe for the specific detection of mutant HIV-1 at codon 97 of the integrase gene.
acaggaagcwgcata

SEQ ID NO: 17795 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (9)..(9): base is a locked nucleic acid
  modified_base (10)..(10): base is a locked nucleic acid
acagayaatgymsyaayt

SEQ ID NO: 17796 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (2)..(2): base is a locked nucleic acid
acagayaatgymsyaayt

SEQ ID NO: 17797 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (7)..(7): base is a locked nucleic acid
acagayaatgymsyaayt

SEQ ID NO: 17798 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (4)..(4): base is a locked nucleic acid
acagayaatgymsyaayt

SEQ ID NO: 17799 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (5)..(5): base is a locked nucleic acid
acagayaatgymsyaayt

SEQ ID NO: 17800 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (15)..(15): base is a locked nucleic acid
acagayaatgymsyaayt

SEQ ID NO: 17801 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (16)..(16): base is a locked nucleic acid
acagayaatgymsyaayt

SEQ ID NO: 17802 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (10)..(10): base is a locked nucleic acid
acagayaatgymsyaayt

SEQ ID NO: 17803 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (11)..(11): base is a locked nucleic acid
acagayaatgymsyaayt

SEQ ID NO: 17804 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (2)..(2): base is a locked nucleic acid
  modified_base (9)..(9): base is a locked nucleic acid
  modified_base (10)..(10): base is a locked nucleic acid
acagayaatgymsyaayt

SEQ ID NO: 17805 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (10)..(10): base is a locked nucleic acid
acagayaatgymsyaayt

SEQ ID NO: 17806 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (3)..(3): base is a locked nucleic acid
  modified_base (9)..(9): base is a locked nucleic acid
  modified_base (10)..(10): base is a locked nucleic acid
acagayaatgymsyaayt

SEQ ID NO: 17807 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (7)..(7): base is a locked nucleic acid
  modified_base (9)..(9): base is a locked nucleic acid
  modified_base (10)..(10): base is a locked nucleic acid
acagayaatgymsyaayt

SEQ ID NO: 17808 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (9)..(9): base is a locked nucleic acid
  modified_base (10)..(10): base is a locked nucleic acid
  modified_base (11)..(11): base is a locked nucleic acid
acagayaatgymsyaayt

SEQ ID NO: 17809 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (9)..(9): base is a locked nucleic acid
  modified_base (10)..(10): base is a locked nucleic acid
  modified_base (14)..(14): base is a locked nucleic acid
acagayaatgymsyaayt

SEQ ID NO: 17810 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (9)..(9): base is a locked nucleic acid
  modified_base (10)..(10): base is a locked nucleic acid
  modified_base (17)..(17): base is a locked nucleic acid
acagayaatgymsyaayt

SEQ ID NO: 17811 - DNA, 18 bp, Artificial Sequence
  Oligonucleotide probe
  misc_binding (1)..(18): Hybridization probe for the specific detection of mutant HIV-1 at codon 118 of the integrase gene.
  modified_base (9)..(9): base is a locked nucleic acid
  modified_base (10)..(10): base is a locked nucleic acid
  modified_base (13)..(13): base is a locked nucleic acid
acagayaatgymsyaayt

SEQ ID NO: 17812 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (8)..(8): base is a locked nucleic acid
  modified_base (9)..(9): base is a locked nucleic acid
cagayaatgymsyaayt

SEQ ID NO: 17813 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (1)..(1): base is a locked nucleic acid
cagayaatgymsyaayt

SEQ ID NO: 17814 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (6)..(6): base is a locked nucleic acid
cagayaatgymsyaayt

SEQ ID NO: 17815 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (3)..(3): base is a locked nucleic acid
cagayaatgymsyaayt

SEQ ID NO: 17816 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (4)..(4): base is a locked nucleic acid
cagayaatgymsyaayt

SEQ ID NO: 17817 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (14)..(14): base is a locked nucleic acid
cagayaatgymsyaayt

SEQ ID NO: 17818 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (15)..(15): base is a locked nucleic acid
cagayaatgymsyaayt

SEQ ID NO: 17819 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (9)..(9): base is a locked nucleic acid
cagayaatgymsyaayt

SEQ ID NO: 17820 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (10)..(10): base is a locked nucleic acid
cagayaatgymsyaayt

SEQ ID NO: 17821 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (1)..(1): base is a locked nucleic acid
  modified_base (8)..(8): base is a locked nucleic acid
  modified_base (9)..(9): base is a locked nucleic acid
cagayaatgymsyaayt

SEQ ID NO: 17822 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (7)..(7): base is a locked nucleic acid
  modified_base (8)..(8): base is a locked nucleic acid
  modified_base (9)..(9): base is a locked nucleic acid
cagayaatgymsyaayt

SEQ ID NO: 17823 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (2)..(2): base is a locked nucleic acid
  modified_base (8)..(8): base is a locked nucleic acid
  modified_base (9)..(9): base is a locked nucleic acid
cagayaatgymsyaayt

SEQ ID NO: 17824 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (6)..(6): base is a locked nucleic acid
  modified_base (8)..(8): base is a locked nucleic acid
  modified_base (9)..(9): base is a locked nucleic acid
cagayaatgymsyaayt

SEQ ID NO: 17825 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (10)..(10): base is a locked nucleic acid
cagayaatgymsyaayt

SEQ ID NO: 17826 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (13)..(13): base is a locked nucleic acid
cagayaatgymsyaayt

SEQ ID NO: 17827 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (16)..(16): base is a locked nucleic acid
cagayaatgymsyaayt

SEQ ID NO: 17828 - DNA, 17 bp, Artificial Sequence
  Oligonucleotide probe
  misc_binding (1)..(17): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (12)..(12): base is a locked nucleic acid
cagayaatgymsyaayt

SEQ ID NO: 17829 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (8)..(8): base is a locked nucleic acid
  modified_base (9)..(9): base is a locked nucleic acid
cagayaatgymsyaa

SEQ ID NO: 17830 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (1)..(1): base is a locked nucleic acid
cagayaatgymsyaa

SEQ ID NO: 17831 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (6)..(6): base is a locked nucleic acid
cagayaatgymsyaa

SEQ ID NO: 17832 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (3)..(3): base is a locked nucleic acid
cagayaatgymsyaa

SEQ ID NO: 17833 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (4)..(4): base is a locked nucleic acid
cagayaatgymsyaa

SEQ ID NO: 17834 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (14)..(14): base is a locked nucleic acid
cagayaatgymsyaa

SEQ ID NO: 17835 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (15)..(15): base is a locked nucleic acid
cagayaatgymsyaa

SEQ ID NO: 17836 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (9)..(9): base is a locked nucleic acid
cagayaatgymsyaa

SEQ ID NO: 17837 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (10)..(10): base is a locked nucleic acid
cagayaatgymsyaa

SEQ ID NO: 17838 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (1)..(1): base is a locked nucleic acid
  modified_base (8)..(8): base is a locked nucleic acid
  modified_base (9)..(9): base is a locked nucleic acid
cagayaatgymsyaa

SEQ ID NO: 17839 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (7)..(7): base is a locked nucleic acid
  modified_base (8)..(8): base is a locked nucleic acid
  modified_base (9)..(9): base is a locked nucleic acid
cagayaatgymsyaa

SEQ ID NO: 17840 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (2)..(2): base is a locked nucleic acid
  modified_base (8)..(8): base is a locked nucleic acid
  modified_base (9)..(9): base is a locked nucleic acid
cagayaatgymsyaa

SEQ ID NO: 17841 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (6)..(6): base is a locked nucleic acid
  modified_base (8)..(8): base is a locked nucleic acid
  modified_base (9)..(9): base is a locked nucleic acid
cagayaatgymsyaa

SEQ ID NO: 17842 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (10)..(10): base is a locked nucleic acid
cagayaatgymsyaa

SEQ ID NO: 17843 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (13)..(13): base is a locked nucleic acid
cagayaatgymsyaa

SEQ ID NO: 17844 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (8)..(8): base is a locked nucleic acid
  modified_base (9)..(9): base is a locked nucleic acid
cagayaatgymsyaa

SEQ ID NO: 17845 - DNA, 15 bp, Artificial Sequence
  Oligonucleotide probe
  misc_binding (1)..(15): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (12)..(12): base is a locked nucleic acid
cagayaatgymsyaa

SEQ ID NO: 17846 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (8)..(8): base is a locked nucleic acid
  modified_base (9)..(9): base is a locked nucleic acid
cagayaatgymsy

SEQ ID NO: 17847 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (1)..(1): base is a locked nucleic acid
cagayaatgymsy

SEQ ID NO: 17848 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (6)..(6): base is a locked nucleic acid
cagayaatgymsy

SEQ ID NO: 17849 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (3)..(3): base is a locked nucleic acid
cagayaatgymsy

SEQ ID NO: 17850 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (4)..(4): base is a locked nucleic acid
cagayaatgymsy

SEQ ID NO: 17851 - DNA, 13 bp, Artificial Sequence
  Oligonucleotide probe
  misc_binding (1)..(13): Hybridization probe for the specific detection of mutant HIV-1 at codon 118 of the integrase gene.
cagayaatgymsy

SEQ ID NO: 17852 - DNA, 14 bp, Artificial Sequence
  Oligonucleotide probe
  misc_binding (1)..(14): Hybridization probe for the specific detection of mutant HIV-1 at codon 118 of the integrase gene.
cagayaatgymsya

SEQ ID NO: 17853 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (9)..(9): base is a locked nucleic acid
cagayaatgymsy

SEQ ID NO: 17854 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (10)..(10): base is a locked nucleic acid
cagayaatgymsy

SEQ ID NO: 17855 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (1)..(1): base is a locked nucleic acid
  modified_base (8)..(8): base is a locked nucleic acid
  modified_base (9)..(9): base is a locked nucleic acid
cagayaatgymsy

SEQ ID NO: 17856 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (7)..(7): base is a locked nucleic acid
  modified_base (8)..(8): base is a locked nucleic acid
  modified_base (9)..(9): base is a locked nucleic acid
cagayaatgymsy

SEQ ID NO: 17857 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (2)..(2): base is a locked nucleic acid
  modified_base (8)..(8): base is a locked nucleic acid
  modified_base (9)..(9): base is a locked nucleic acid
cagayaatgymsy

SEQ ID NO: 17858 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (6)..(6): base is a locked nucleic acid
  modified_base (8)..(8): base is a locked nucleic acid
  modified_base (9)..(9): base is a locked nucleic acid
cagayaatgymsy

SEQ ID NO: 17859 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (10)..(10): base is a locked nucleic acid
cagayaatgymsy

SEQ ID NO: 17860 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (13)..(13): base is a locked nucleic acid
cagayaatgymsy

SEQ ID NO: 17861 - DNA, 14 bp, Artificial Sequence
  Oligonucleotide probe
  misc_binding (1)..(14): Hybridization probe for the specific detection of mutant HIV-1 at codon 118 of the integrase gene.
  modified_base (8)..(8): base is a locked nucleic acid
  modified_base (9)..(9): base is a locked nucleic acid
cagayaatgymsya

SEQ ID NO: 17862 - DNA, 13 bp, Artificial Sequence
  Oligonucleotide probe
  misc_binding (1)..(13): Hybridization probe for the specific detection of mutant HIV-1 at codon 118 of the integrase gene.
  modified_base (8)..(8): base is a locked nucleic acid
  modified_base (9)..(9): base is a locked nucleic acid
  modified_base (12)..(12): base is a locked nucleic acid
cagayaatgymsy

SEQ ID NO: 17863 - DNA, 18 bp, Artificial Sequence
  Oligonucleotide probe
  misc_binding (1)..(18): Hybridization probe for the specific detection of mutant HIV-1 at codon 118 of the integrase gene.
acagayaatgymsyaayt

SEQ ID NO: 17864 - DNA, 17 bp, Artificial Sequence
  Oligonucleotide probe
  misc_binding (1)..(17): Hybridization probe for the specific detection of mutant HIV-1 at codon 118 of the integrase gene.
cagayaatgymsyaayt

SEQ ID NO: 17865 - DNA, 15 bp, Artificial Sequence
  Oligonucleotide probe
  misc_binding (1)..(15): Hybridization probe for the specific detection of mutant HIV-1 at codon 118 of the integrase gene.
cagayaatgymsyaa

SEQ ID NO: 17866 - DNA, 13 bp, Artificial Sequence
  Oligonucleotide probe
  misc_binding (1)..(13): Hybridization probe for the specific detection of mutant HIV-1 at codon 118 of the integrase gene.
cagayaatgymsy

SEQ ID NO: 17867 - DNA, 15 bp, Artificial Sequence
  Oligonucleotide probe
  misc_binding (1)..(15): Hybridization probe for the specific detection of mutant HIV-1 at codon 118 of the integrase gene.
  misc_feature (10)..(10): n is a, c, g, or t
agacaatcgnagcaa

SEQ ID NO: 17868 - DNA, 15 bp, Artificial Sequence
  Oligonucleotide probe
  misc_binding (1)..(15): Hybridization probe for the specific detection of mutant HIV-1 at codon 118 of the integrase gene.
agacaatagragcaa

SEQ ID NO: 17869 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (9)..(9): base is a locked nucleic acid
  modified_base (10)..(10): base is a locked nucleic acid
gymsyaaytyacyagyrv

SEQ ID NO: 17870 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (8)..(8): base is a locked nucleic acid
gymsyaaytyacyagyrv

SEQ ID NO: 17871 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (2)..(2): base is a locked nucleic acid
gymsyaaytyacyagyrv

SEQ ID NO: 17872 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (3)..(3): base is a locked nucleic acid
gymsyaaytyacyagyrv

SEQ ID NO: 17873 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (5)..(5): base is a locked nucleic acid
gymsyaaytyacyagyrv

SEQ ID NO: 17874 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (14)..(14): base is a locked nucleic acid
gymsyaaytyacyagyrv

SEQ ID NO: 17875 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (12)..(12): base is a locked nucleic acid
gymsyaaytyacyagyrv

SEQ ID NO: 17876 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (11)..(11): base is a locked nucleic acid
gymsyaaytyacyagyrv

SEQ ID NO: 17877 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (18)..(18): base is a locked nucleic acid
gymsyaaytyacyagyrv

SEQ ID NO: 17878 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (10)..(10): base is a locked nucleic acid
gymsyaaytyacyagyrv

SEQ ID NO: 17879 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (5)..(5): base is a locked nucleic acid
  modified_base (9)..(9): base is a locked nucleic acid
  modified_base (10)..(10): base is a locked nucleic acid
gymsyaaytyacyagyrv

SEQ ID NO: 17880 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (2)..(2): base is a locked nucleic acid
  modified_base (9)..(9): base is a locked nucleic acid
  modified_base (10)..(10): base is a locked nucleic acid
gymsyaaytyacyagyrv

SEQ ID NO: 17881 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (7)..(7): base is a locked nucleic acid
  modified_base (9)..(9): base is a locked nucleic acid
  modified_base (10)..(10): base is a locked nucleic acid
gymsyaaytyacyagyrv

SEQ ID NO: 17882 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (9)..(9): base is a locked nucleic acid
  modified_base (10)..(10): base is a locked nucleic acid
  modified_base (14)..(14): base is a locked nucleic acid
gymsyaaytyacyagyrv

SEQ ID NO: 17883 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (9)..(9): base is a locked nucleic acid
  modified_base (10)..(10): base is a locked nucleic acid
  modified_base (18)..(18): base is a locked nucleic acid
gymsyaaytyacyagyrv

SEQ ID NO: 17884 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (9)..(9): base is a locked nucleic acid
  modified_base (10)..(10): base is a locked nucleic acid
  modified_base (13)..(13): base is a locked nucleic acid
gymsyaaytyacyagyrv

SEQ ID NO: 17885 - DNA, 18 bp, Artificial Sequence
  Oligonucleotide probe
  misc_binding (1)..(18): Hybridization probe for the specific detection of mutant HIV-1 at codon 121 of the integrase gene.
  modified_base (9)..(9): base is a locked nucleic acid
  modified_base (10)..(10): base is a locked nucleic acid
  modified_base (12)..(12): base is a locked nucleic acid
gymsyaaytyacyagyrv

SEQ ID NO: 17886 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (8)..(8): base is a locked nucleic acid
  modified_base (9)..(9): base is a locked nucleic acid
ymsyaaytyacyagyrv

SEQ ID NO: 17887 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (7)..(7): base is a locked nucleic acid
ymsyaaytyacyagyrv

SEQ ID NO: 17888 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (1)..(1): base is a locked nucleic acid
ymsyaaytyacyagyrv

SEQ ID NO: 17889 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (2)..(2): base is a locked nucleic acid
ymsyaaytyacyagyrv

SEQ ID NO: 17890 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (4)..(4): base is a locked nucleic acid
ymsyaaytyacyagyrv

SEQ ID NO: 17891 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (13)..(13): base is a locked nucleic acid
ymsyaaytyacyagyrv

SEQ ID NO: 17892 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (11)..(11): base is a locked nucleic acid
ymsyaaytyacyagyrv

SEQ ID NO: 17893 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (10)..(10): base is a locked nucleic acid
ymsyaaytyacyagyrv

SEQ ID NO: 17894 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (17)..(17): base is a locked nucleic acid
ymsyaaytyacyagyrv

SEQ ID NO: 17895 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (7)..(7): base is a locked nucleic acid
  modified_base (8)..(8): base is a locked nucleic acid
  modified_base (9)..(9): base is a locked nucleic acid
ymsyaaytyacyagyrv

SEQ ID NO: 17896 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (4)..(4): base is a locked nucleic acid
  modified_base (8)..(8): base is a locked nucleic acid
  modified_base (9)..(9): base is a locked nucleic acid
ymsyaaytyacyagyrv

SEQ ID NO: 17897 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (1)..(1): base is a locked nucleic acid
  modified_base (8)..(8): base is a locked nucleic acid
  modified_base (9)..(9): base is a locked nucleic acid
ymsyaaytyacyagyrv

SEQ ID NO: 17898 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (6)..(6): base is a locked nucleic acid
  modified_base (8)..(8): base is a locked nucleic acid
  modified_base (9)..(9): base is a locked nucleic acid
ymsyaaytyacyagyrv

SEQ ID NO: 17899 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (13)..(13): base is a locked nucleic acid
ymsyaaytyacyagyrv

SEQ ID NO: 17900 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (17)..(17): base is a locked nucleic acid
ymsyaaytyacyagyrv

SEQ ID NO: 17901 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (12)..(12): base is a locked nucleic acid
ymsyaaytyacyagyrv

SEQ ID NO: 17902 - DNA, 17 bp, Artificial Sequence
  Oligonucleotide probe
  misc_binding (1)..(17): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (11)..(11): base is a locked nucleic acid
ymsyaaytyacyagyrv

SEQ ID NO: 17903 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (8)..(8): base is a locked nucleic acid
  modified_base (9)..(9): base is a locked nucleic acid
ymsyaaytyacyagy

SEQ ID NO: 17904 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (7)..(7): base is a locked nucleic acid
ymsyaaytyacyagy

SEQ ID NO: 17905 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (1)..(1): base is a locked nucleic acid
ymsyaaytyacyagy

SEQ ID NO: 17906 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (2)..(2): base is a locked nucleic acid
ymsyaaytyacyagy

SEQ ID NO: 17907 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (4)..(4): base is a locked nucleic acid
ymsyaaytyacyagy

SEQ ID NO: 17908 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (13)..(13): base is a locked nucleic acid
ymsyaaytyacyagy

SEQ ID NO: 17909 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (11)..(11): base is a locked nucleic acid
ymsyaaytyacyagy

SEQ ID NO: 17910 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (10)..(10): base is a locked nucleic acid
ymsyaaytyacyagy

SEQ ID NO: 17911 - DNA, 16 bp, Artificial Sequence
  Oligonucleotide probe
  misc_binding (1)..(16): Hybridization probe for the specific detection of mutant HIV-1 at codon 121 of the integrase gene.
ymsyaaytyacyagyr

SEQ ID NO: 17912 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (7)..(7): base is a locked nucleic acid
  modified_base (8)..(8): base is a locked nucleic acid
  modified_base (9)..(9): base is a locked nucleic acid
ymsyaaytyacyagy

SEQ ID NO: 17913 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (4)..(4): base is a locked nucleic acid
  modified_base (8)..(8): base is a locked nucleic acid
  modified_base (9)..(9): base is a locked nucleic acid
ymsyaaytyacyagy

SEQ ID NO: 17914 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (1)..(1): base is a locked nucleic acid
  modified_base (8)..(8): base is a locked nucleic acid
  modified_base (9)..(9): base is a locked nucleic acid
ymsyaaytyacyagy

SEQ ID NO: 17915 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (6)..(6): base is a locked nucleic acid
  modified_base (8)..(8): base is a locked nucleic acid
  modified_base (9)..(9): base is a locked nucleic acid
ymsyaaytyacyagy

SEQ ID NO: 17916 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (13)..(13): base is a locked nucleic acid
ymsyaaytyacyagy

SEQ ID NO: 17917 - DNA, 16 bp, Artificial Sequence
  Oligonucleotide probe
  misc_binding (1)..(16): Hybridization probe for the specific detection of mutant HIV-1 at codon 121 of the integrase gene.
  modified_base (8)..(8): base is a locked nucleic acid
  modified_base (9)..(9): base is a locked nucleic acid
ymsyaaytyacyagyr

SEQ ID NO: 17918 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (12)..(12): base is a locked nucleic acid
ymsyaaytyacyagy

SEQ ID NO: 17919 - DNA, 15 bp, Artificial Sequence
  Oligonucleotide probe
  misc_binding (1)..(15): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (11)..(11): base is a locked nucleic acid
ymsyaaytyacyagy

SEQ ID NO: 17920 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (8)..(8): base is a locked nucleic acid
  modified_base (9)..(9): base is a locked nucleic acid
ymsyaaytyacya

SEQ ID NO: 17921 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (7)..(7): base is a locked nucleic acid
ymsyaaytyacya

SEQ ID NO: 17922 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (1)..(1): base is a locked nucleic acid
ymsyaaytyacya

SEQ ID NO: 17923 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (2)..(2): base is a locked nucleic acid
ymsyaaytyacya

SEQ ID NO: 17924 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (4)..(4): base is a locked nucleic acid
ymsyaaytyacya

SEQ ID NO: 17925 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (13)..(13): base is a locked nucleic acid
ymsyaaytyacya

SEQ ID NO: 17926 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (11)..(11): base is a locked nucleic acid
ymsyaaytyacya

SEQ ID NO: 17927 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (10)..(10): base is a locked nucleic acid
ymsyaaytyacya

SEQ ID NO: 17928 - DNA, 14 bp, Artificial Sequence
  Oligonucleotide probe
  misc_binding (1)..(14): Hybridization probe for the specific detection of mutant HIV-1 at codon 121 of the integrase gene.
ymsyaaytyacyag

SEQ ID NO: 17929 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (7)..(7): base is a locked nucleic acid
  modified_base (8)..(8): base is a locked nucleic acid
  modified_base (9)..(9): base is a locked nucleic acid
ymsyaaytyacya

SEQ ID NO: 17930 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (4)..(4): base is a locked nucleic acid
  modified_base (8)..(8): base is a locked nucleic acid
  modified_base (9)..(9): base is a locked nucleic acid
ymsyaaytyacya

SEQ ID NO: 17931 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (1)..(1): base is a locked nucleic acid
  modified_base (8)..(8): base is a locked nucleic acid
  modified_base (9)..(9): base is a locked nucleic acid
ymsyaaytyacya

SEQ ID NO: 17932 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (6)..(6): base is a locked nucleic acid
  modified_base (8)..(8): base is a locked nucleic acid
  modified_base (9)..(9): base is a locked nucleic acid
ymsyaaytyacya

SEQ ID NO: 17933 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (13)..(13): base is a locked nucleic acid
ymsyaaytyacya

SEQ ID NO: 17934 - DNA, 14 bp, Artificial Sequence
  Oligonucleotide probe
  misc_binding (1)..(14): Hybridization probe for the specific detection of mutant HIV-1 at codon 121 of the integrase gene.
  modified_base (8)..(8): base is a locked nucleic acid
  modified_base (9)..(9): base is a locked nucleic acid
ymsyaaytyacyag

SEQ ID NO: 17935 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (12)..(12): base is a locked nucleic acid
ymsyaaytyacya

SEQ ID NO: 17936 - DNA, 13 bp, Artificial Sequence
  Oligonucleotide probe
  misc_binding (1)..(13): Hybridization probe for the specific detection of mutant HIV-1 at codon 121 of the integrase gene.
  modified_base (8)..(8): base is a locked nucleic acid
  modified_base (9)..(9): base is a locked nucleic acid
  modified_base (11)..(11): base is a locked nucleic acid
ymsyaaytyacya

SEQ ID NO: 17937 - DNA, 18 bp, Artificial Sequence
  Oligonucleotide probe
  misc_binding (1)..(18): Hybridization probe for the specific detection of mutant HIV-1 at codon 121 of the integrase gene.
gymsyaaytyacyagyrv

SEQ ID NO: 17938 - DNA, 17 bp, Artificial Sequence
  Oligonucleotide probe
  misc_binding (1)..(17): Hybridization probe for the specific detection of mutant HIV-1 at codon 121 of the integrase gene.
ymsyaaytyacyagyrv

SEQ ID NO: 17939 - DNA, 15 bp, Artificial Sequence
  Oligonucleotide probe
  misc_binding (1)..(15): Hybridization probe for the specific detection of mutant HIV-1 at codon 121 of the integrase gene.
ymsyaaytyacyagy

SEQ ID NO: 17940 - DNA, 13 bp, Artificial Sequence
  Oligonucleotide probe
  misc_binding (1)..(13): Hybridization probe for the specific detection of mutant HIV-1 at codon 121 of the integrase gene.
ymsyaaytyacya

SEQ ID NO: 17941 - DNA, 15 bp, Artificial Sequence
  Oligonucleotide probe
  misc_binding (1)..(15): Hybridization probe for the specific detection of mutant HIV-1 at codon 121 of the integrase gene.
agcaattayaccagt

SEQ ID NO: 17942 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
tcmmrcargatttggvat

SEQ ID NO: 17943 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (8)..(8): base is a locked nucleic acid
tcmmrcargatttggvat

SEQ ID NO: 17944 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (4)..(4): base is a locked nucleic acid
tcmmrcargatttggvat

SEQ ID NO: 17945 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (3)..(3): base is a locked nucleic acid
tcmmrcargatttggvat

SEQ ID NO: 17946 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
tcmmrcargatttggvat

SEQ ID NO: 17947 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (12)..(12): base is a locked nucleic acid
tcmmrcargatttggvat

SEQ ID NO: 17948 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (18)..(18): base is a locked nucleic acid
tcmmrcargatttggvat

SEQ ID NO: 17949 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (10)..(10): base is a locked nucleic acid
tcmmrcargatttggvat

SEQ ID NO: 17950 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (17)..(17): base is a locked nucleic acid
tcmmrcargatttggvat

SEQ ID NO: 17951 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (3)..(3): base is a locked nucleic acid
  modified_base (9)..(9): base is a locked nucleic acid
  modified_base (10)..(10): base is a locked nucleic acid
tcmmrcargatttggvat

SEQ ID NO: 17952 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (7)..(7): base is a locked nucleic acid
  modified_base (9)..(9): base is a locked nucleic acid
  modified_base (10)..(10): base is a locked nucleic acid
tcmmrcargatttggvat

SEQ ID NO: 17953 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (4)..(4): base is a locked nucleic acid
  modified_base (9)..(9): base is a locked nucleic acid
  modified_base (10)..(10): base is a locked nucleic acid
tcmmrcargatttggvat

SEQ ID NO: 17954 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (5)..(5): base is a locked nucleic acid
  modified_base (9)..(9): base is a locked nucleic acid
  modified_base (10)..(10): base is a locked nucleic acid
tcmmrcargatttggvat

SEQ ID NO: 17955 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (18)..(18): base is a locked nucleic acid
tcmmrcargatttggvat

SEQ ID NO: 17956 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (13)..(13): base is a locked nucleic acid
tcmmrcargatttggvat

SEQ ID NO: 17957 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (14)..(14): base is a locked nucleic acid
tcmmrcargatttggvat

SEQ ID NO: 17958 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (11)..(11): base is a locked nucleic acid
tcmmrcargatttggvat

SEQ ID NO: 17959 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
rtcmmrcaraatttggva

SEQ ID NO: 17960 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (4)..(4): base is a locked nucleic acid
rtcmmrcaraatttggva

SEQ ID NO: 17961 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (2)..(2): base is a locked nucleic acid
rtcmmrcaraatttggva

SEQ ID NO: 17962 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (5)..(5): base is a locked nucleic acid
rtcmmrcaraatttggva

SEQ ID NO: 17963 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (8)..(8): base is a locked nucleic acid
rtcmmrcaraatttggva

SEQ ID NO: 17964 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (18)..(18): base is a locked nucleic acid
rtcmmrcaraatttggva

SEQ ID NO: 17965 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (10)..(10): base is a locked nucleic acid
rtcmmrcaraatttggva

SEQ ID NO: 17966 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (13)..(13): base is a locked nucleic acid
rtcmmrcaraatttggva

SEQ ID NO: 17967 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (11)..(11): base is a locked nucleic acid
rtcmmrcaraatttggva

SEQ ID NO: 17968 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (10)..(10): base is a locked nucleic acid
rtcmmrcaraatttggva

SEQ ID NO: 17969 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (6)..(6): base is a locked nucleic acid
  modified_base (9)..(9): base is a locked nucleic acid
  modified_base (10)..(10): base is a locked nucleic acid
rtcmmrcaraatttggva

SEQ ID NO: 17970 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (3)..(3): base is a locked nucleic acid
  modified_base (9)..(9): base is a locked nucleic acid
  modified_base (10)..(10): base is a locked nucleic acid
rtcmmrcaraatttggva

SEQ ID NO: 17971 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (4)..(4): base is a locked nucleic acid
  modified_base (9)..(9): base is a locked nucleic acid
  modified_base (10)..(10): base is a locked nucleic acid
rtcmmrcaraatttggva

SEQ ID NO: 17972 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (13)..(13): base is a locked nucleic acid
rtcmmrcaraatttggva

SEQ ID NO: 17973 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (11)..(11): base is a locked nucleic acid
rtcmmrcaraatttggva

SEQ ID NO: 17974 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (17)..(17): base is a locked nucleic acid
rtcmmrcaraatttggva

SEQ ID NO: 17975 - DNA, 18 bp, Artificial Sequence
  Oligonucleotide probe
  misc_binding (1)..(18): Hybridization probe for the specific detection of mutant HIV-1 at codon 138 of the integrase gene.
  modified_base (9)..(9): base is a locked nucleic acid
  modified_base (10)..(10): base is a locked nucleic acid
  modified_base (12)..(12): base is a locked nucleic acid
rtcmmrcaraatttggva

SEQ ID NO: 17976 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
cmmrcargatttggvat

SEQ ID NO: 17977 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (7)..(7): base is a locked nucleic acid
cmmrcargatttggvat

SEQ ID NO: 17978 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (3)..(3): base is a locked nucleic acid
cmmrcargatttggvat

SEQ ID NO: 17979 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (2)..(2): base is a locked nucleic acid
cmmrcargatttggvat

SEQ ID NO: 17980 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
cmmrcargatttggvat

SEQ ID NO: 17981 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (11)..(11): base is a locked nucleic acid
cmmrcargatttggvat

SEQ ID NO: 17982 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (17)..(17): base is a locked nucleic acid
cmmrcargatttggvat

SEQ ID NO: 17983 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (9)..(9): base is a locked nucleic acid
cmmrcargatttggvat

SEQ ID NO: 17984 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (16)..(16): base is a locked nucleic acid
cmmrcargatttggvat

SEQ ID NO: 17985 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (2)..(2): base is a locked nucleic acid
  modified_base (8)..(8): base is a locked nucleic acid
  modified_base (9)..(9): base is a locked nucleic acid
cmmrcargatttggvat

SEQ ID NO: 17986 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (6)..(6): base is a locked nucleic acid
  modified_base (8)..(8): base is a locked nucleic acid
  modified_base (9)..(9): base is a locked nucleic acid
cmmrcargatttggvat

SEQ ID NO: 17987 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (3)..(3): base is a locked nucleic acid
  modified_base (8)..(8): base is a locked nucleic acid
  modified_base (9)..(9): base is a locked nucleic acid
cmmrcargatttggvat

SEQ ID NO: 17988 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (4)..(4): base is a locked nucleic acid
  modified_base (8)..(8): base is a locked nucleic acid
  modified_base (9)..(9): base is a locked nucleic acid
cmmrcargatttggvat

SEQ ID NO: 17989 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (17)..(17): base is a locked nucleic acid
cmmrcargatttggvat

SEQ ID NO: 17990 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (12)..(12): base is a locked nucleic acid
cmmrcargatttggvat

SEQ ID NO: 17991 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (13)..(13): base is a locked nucleic acid
cmmrcargatttggvat

SEQ ID NO: 17992 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (10)..(10): base is a locked nucleic acid
cmmrcargatttggvat

SEQ ID NO: 17993 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
tcmmrcaraatttggva

SEQ ID NO: 17994 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (3)..(3): base is a locked nucleic acid
tcmmrcaraatttggva

SEQ ID NO: 17995 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (1)..(1): base is a locked nucleic acid
tcmmrcaraatttggva

SEQ ID NO: 17996 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (4)..(4): base is a locked nucleic acid
tcmmrcaraatttggva

SEQ ID NO: 17997 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (7)..(7): base is a locked nucleic acid
tcmmrcaraatttggva

SEQ ID NO: 17998 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (17)..(17): base is a locked nucleic acid
tcmmrcaraatttggva

SEQ ID NO: 17999 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (9)..(9): base is a locked nucleic acid
tcmmrcaraatttggva

SEQ ID NO: 18000 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (12)..(12): base is a locked nucleic acid
tcmmrcaraatttggva

SEQ ID NO: 18001 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (10)..(10): base is a locked nucleic acid
tcmmrcaraatttggva

SEQ ID NO: 18002 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (7)..(7): base is a locked nucleic acid
  modified_base (8)..(8): base is a locked nucleic acid
  modified_base (9)..(9): base is a locked nucleic acid
tcmmrcaraatttggva

SEQ ID NO: 18003 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (5)..(5): base is a locked nucleic acid
  modified_base (8)..(8): base is a locked nucleic acid
  modified_base (9)..(9): base is a locked nucleic acid
tcmmrcaraatttggva

SEQ ID NO: 18004 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (2)..(2): base is a locked nucleic acid
  modified_base (8)..(8): base is a locked nucleic acid
  modified_base (9)..(9): base is a locked nucleic acid
tcmmrcaraatttggva

SEQ ID NO: 18005 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (3)..(3): base is a locked nucleic acid
  modified_base (8)..(8): base is a locked nucleic acid
  modified_base (9)..(9): base is a locked nucleic acid
tcmmrcaraatttggva

SEQ ID NO: 18006 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (12)..(12): base is a locked nucleic acid
tcmmrcaraatttggva

SEQ ID NO: 18007 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (10)..(10): base is a locked nucleic acid
tcmmrcaraatttggva

SEQ ID NO: 18008 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (16)..(16): base is a locked nucleic acid
tcmmrcaraatttggva

SEQ ID NO: 18009 - DNA, 17 bp, Artificial Sequence
  Oligonucleotide probe
  misc_binding (1)..(17): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (11)..(11): base is a locked nucleic acid
tcmmrcaraatttggva

SEQ ID NO: 18010 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
cmmrcargatttggv

SEQ ID NO: 18011 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (7)..(7): base is a locked nucleic acid
cmmrcargatttggv

SEQ ID NO: 18012 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (3)..(3): base is a locked nucleic acid
cmmrcargatttggv

SEQ ID NO: 18013 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (2)..(2): base is a locked nucleic acid
cmmrcargatttggv

SEQ ID NO: 18014 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
cmmrcargatttggv

SEQ ID NO: 18015 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (11)..(11): base is a locked nucleic acid
cmmrcargatttggv

SEQ ID NO: 18016 - DNA, 16 bp, Artificial Sequence
  Oligonucleotide probe
  misc_binding (1)..(16): Hybridization probe for the specific detection of mutant HIV-1 at codon 138 of the integrase gene.
cmmrcargatttggva

SEQ ID NO: 18017 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (9)..(9): base is a locked nucleic acid
cmmrcargatttggv

SEQ ID NO: 18018 - DNA, 15 bp, Artificial Sequence
  Oligonucleotide probe
  misc_binding (1)..(15): Hybridization probe for the specific detection of mutant HIV-1 at codon 138 of the integrase gene.
cmmrcargatttggv

SEQ ID NO: 18019 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (2)..(2): base is a locked nucleic acid
  modified_base (8)..(8): base is a locked nucleic acid
  modified_base (9)..(9): base is a locked nucleic acid
cmmrcargatttggv

SEQ ID NO: 18020 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (6)..(6): base is a locked nucleic acid
  modified_base (8)..(8): base is a locked nucleic acid
  modified_base (9)..(9): base is a locked nucleic acid
cmmrcargatttggv

SEQ ID NO: 18021 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (3)..(3): base is a locked nucleic acid
  modified_base (8)..(8): base is a locked nucleic acid
  modified_base (9)..(9): base is a locked nucleic acid
cmmrcargatttggv

SEQ ID NO: 18022 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (4)..(4): base is a locked nucleic acid
  modified_base (8)..(8): base is a locked nucleic acid
  modified_base (9)..(9): base is a locked nucleic acid
cmmrcargatttggv

SEQ ID NO: 18023 - DNA, 16 bp, Artificial Sequence
  Oligonucleotide probe
  misc_binding (1)..(16): Hybridization probe for the specific detection of mutant HIV-1 at codon 138 of the integrase gene.
  modified_base (8)..(8): base is a locked nucleic acid
  modified_base (9)..(9): base is a locked nucleic acid
cmmrcargatttggva

SEQ ID NO: 18024 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (12)..(12): base is a locked nucleic acid
cmmrcargatttggv

SEQ ID NO: 18025 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (13)..(13): base is a locked nucleic acid
cmmrcargatttggv

SEQ ID NO: 18026 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (10)..(10): base is a locked nucleic acid
cmmrcargatttggv

SEQ ID NO: 18027 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
tcmmrcaraatttgg

SEQ ID NO: 18028 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (3)..(3): base is a locked nucleic acid
tcmmrcaraatttgg

SEQ ID NO: 18029 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (1)..(1): base is a locked nucleic acid
tcmmrcaraatttgg

SEQ ID NO: 18030 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (4)..(4): base is a locked nucleic acid
tcmmrcaraatttgg

SEQ ID NO: 18031 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (7)..(7): base is a locked nucleic acid
tcmmrcaraatttgg

SEQ ID NO: 18032 - DNA, 16 bp, Artificial Sequence
  Oligonucleotide probe
  misc_binding (1)..(16): Hybridization probe for the specific detection of mutant HIV-1 at codon 138 of the integrase gene.
tcmmrcaraatttggv

SEQ ID NO: 18033 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (9)..(9): base is a locked nucleic acid
tcmmrcaraatttgg

SEQ ID NO: 18034 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (12)..(12): base is a locked nucleic acid
tcmmrcaraatttgg

SEQ ID NO: 18035 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (10)..(10): base is a locked nucleic acid
tcmmrcaraatttgg

SEQ ID NO: 18036 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (7)..(7): base is a locked nucleic acid
  modified_base (8)..(8): base is a locked nucleic acid
  modified_base (9)..(9): base is a locked nucleic acid
tcmmrcaraatttgg

SEQ ID NO: 18037 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (5)..(5): base is a locked nucleic acid
  modified_base (8)..(8): base is a locked nucleic acid
  modified_base (9)..(9): base is a locked nucleic acid
tcmmrcaraatttgg

SEQ ID NO: 18038 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (2)..(2): base is a locked nucleic acid
  modified_base (8)..(8): base is a locked nucleic acid
  modified_base (9)..(9): base is a locked nucleic acid
tcmmrcaraatttgg

SEQ ID NO: 18039 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (3)..(3): base is a locked nucleic acid
  modified_base (8)..(8): base is a locked nucleic acid
  modified_base (9)..(9): base is a locked nucleic acid
tcmmrcaraatttgg

SEQ ID NO: 18040 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (12)..(12): base is a locked nucleic acid
tcmmrcaraatttgg

SEQ ID NO: 18041 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (10)..(10): base is a locked nucleic acid
tcmmrcaraatttgg

SEQ ID NO: 18042 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
tcmmrcaraatttgg

SEQ ID NO: 18043 - DNA, 15 bp, Artificial Sequence
  Oligonucleotide probe
  misc_binding (1)..(15): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (11)..(11): base is a locked nucleic acid
tcmmrcaraatttgg

SEQ ID NO: 18044 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
cmmrcargatttg

SEQ ID NO: 18045 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (7)..(7): base is a locked nucleic acid
cmmrcargatttg

SEQ ID NO: 18046 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (3)..(3): base is a locked nucleic acid
cmmrcargatttg

SEQ ID NO: 18047 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (2)..(2): base is a locked nucleic acid
cmmrcargatttg

SEQ ID NO: 18048 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
cmmrcargatttg

SEQ ID NO: 18049 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (11)..(11): base is a locked nucleic acid
cmmrcargatttg

SEQ ID NO: 18050 - DNA, 14 bp, Artificial Sequence
  Oligonucleotide probe
  misc_binding (1)..(14): Hybridization probe for the specific detection of mutant HIV-1 at codon 138 of the integrase gene.
cmmrcargatttgg

SEQ ID NO: 18051 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (9)..(9): base is a locked nucleic acid
cmmrcargatttg

SEQ ID NO: 18052 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (2)..(2): base is a locked nucleic acid
  modified_base (8)..(8): base is a locked nucleic acid
  modified_base (9)..(9): base is a locked nucleic acid
cmmrcargatttg

SEQ ID NO: 18053 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (6)..(6): base is a locked nucleic acid
  modified_base (8)..(8): base is a locked nucleic acid
  modified_base (9)..(9): base is a locked nucleic acid
cmmrcargatttg

SEQ ID NO: 18054 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (3)..(3): base is a locked nucleic acid
  modified_base (8)..(8): base is a locked nucleic acid
  modified_base (9)..(9): base is a locked nucleic acid
cmmrcargatttg

SEQ ID NO: 18055 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (4)..(4): base is a locked nucleic acid
  modified_base (8)..(8): base is a locked nucleic acid
  modified_base (9)..(9): base is a locked nucleic acid
cmmrcargatttg

SEQ ID NO: 18056 - DNA, 14 bp, Artificial Sequence
  Oligonucleotide probe
  misc_binding (1)..(14): Hybridization probe for the specific detection of mutant HIV-1 at codon 138 of the integrase gene.
  modified_base (8)..(8): base is a locked nucleic acid
  modified_base (9)..(9): base is a locked nucleic acid
cmmrcargatttgg

SEQ ID NO: 18057 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (12)..(12): base is a locked nucleic acid
cmmrcargatttg

SEQ ID NO: 18058 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (13)..(13): base is a locked nucleic acid
cmmrcargatttg
